US006469142B1

(12) United States Patent
Daggett et al.

(10) Patent No.: US 6,469,142 B1
(45) Date of Patent: Oct. 22, 2002

(54) HUMAN N-METHYL-D-ASPARTATE RECEPTOR SUBUNITS, NUCLEIC ACIDS ENCODING SAME AND USES THEREFOR

(75) Inventors: Lorrie P. Daggett, San Diego, CA (US); Chin-Chun Lu, San Diego, CA (US)

(73) Assignee: Merck & Co., Inc., Rahway, NJ (US)

( * ) Notice: Subject to any disclaimer, the term of this patent is extended or adjusted under 35 U.S.C. 154(b) by 0 days.

(21) Appl. No.: 09/648,797

(22) Filed: Aug. 28, 2000

Related U.S. Application Data

(60) Division of application No. 08/940,086, filed on Sep. 29, 1997, now Pat. No. 6,111,091, which is a division of application No. 08/231,193, filed on Apr. 20, 1994, now Pat. No. 5,849,895, which is a continuation-in-part of application No. 08/052,449, filed on Apr. 20, 1993, now abandoned.

(51) Int. Cl.⁷ .......................................... C07K 14/705
(52) U.S. Cl. ..................................................... 530/350
(58) Field of Search ........................................ 530/350

(56) References Cited

U.S. PATENT DOCUMENTS

| 4,837,148 A | 6/1989 | Cregg ..................... 435/172.3 |
| 4,855,231 A | 8/1989 | Stroman et al. .............. 435/68 |
| 4,882,279 A | 11/1989 | Cregg ......................... 435/68 |
| 4,929,555 A | 5/1990 | Cregg et al. ............. 435/172.3 |
| 5,024,939 A | 6/1991 | Gorman ..................... 435/69.1 |
| 5,028,707 A | 7/1991 | Nichols et al. ............. 546/156 |
| 5,202,257 A | 4/1993 | Heinemann et al. ..... 435/252.3 |
| 5,401,629 A | 3/1995 | Harpold et al. ................ 435/6 |
| 5,403,484 A | 4/1995 | Ladner et al. ........... 435/235.1 |
| 5,436,128 A | 7/1995 | Harpold et al. ................ 435/6 |
| 5,502,166 A | 3/1996 | Mishina ..................... 530/350 |
| 5,648,259 A | 7/1997 | Mallet ..................... 435/252.3 |

FOREIGN PATENT DOCUMENTS

| EP | 0600278 | 6/1994 |
| EP | 0606734 | 7/1994 |
| EP | 0674003 | 9/1995 |
| GB | 9223769 | 11/1992 |
| GB | 9307026 | 4/1993 |
| GB | 2291647 | 1/1996 |
| JP | 6014783 | 1/1994 |
| WO | 9106648 | 5/1991 |
| WO | 9313423 | 7/1993 |
| WO | 9323536 | 11/1993 |
| WO | 9324629 | 12/1993 |
| WO | 9325679 | 12/1993 |
| WO | 9401094 | 1/1994 |
| WO | 9404698 | 3/1994 |
| WO | 9406428 | 3/1994 |
| WO | 9411501 | 5/1994 |
| WO | 9526401 | 10/1995 |

OTHER PUBLICATIONS

George et al., Current Methods in Sequence Comparison, *Macromolecular Sequencing and Synthesis Selected Methgods and Applications*, Alan R. Liss, Inc., pp. 127–149 (1988).

Grenningloh et al., Alpha subunit variants of the human glycine receptor: primary structures, functional expression and chromosomal localization of the corresponding genes, *The EMBO J.* 9(3): 771–776 (1990).

Puckett et al., Molecular cloning and chromosomal localization of one of the human glutamate receptor genes, *Proc. Natl. Acad. Sci. U.S.A.* 88: 7557–7561 (1991).

Schofield et al., Seuqnece and expression of huyman GABA$_A$ α1 and Δ1 subunits, *FEBS Lett.* 244(2): 361–364 (1989).

Sun et al., Molecular cloning, chromosomal mapping, and functional expression of human brain glutamate receptors, *Proc. Natl. Acad. Sci. U.S.A.* 89:1443–1447 (1992).

Abbott, NMDA receptor cloned, *Trends Pharmacol. Sci.* 12:449 (1991).

(List continued on next page.)

*Primary Examiner*—John Ulm
(74) *Attorney, Agent, or Firm*—Vineet Kohli; Jack L. Tribble

(57) ABSTRACT

In accordance with the present invention, there are provided nucleic acids encoding human NMDA receptor protein subunits and the proteins encoded thereby. The NMDA receptor subunits of the invention comprise components of NMDA receptors that have cation-selective channels and bind glutamate and NMDA. In one aspect of the invention, the nucleic acids encode NMDAR1 and NMDAR2 subunits of human NMDA receptors. In a preferred embodiment, the invention nucleic acids encode NMDAR1, NMDAR2A, NMDAR2B, NMDAR2C and NMDAR2D subunits of human NMDA receptors. In addition to being useful for the production of NMDA receptor subunit proteins, these nucleic acids are also useful as probes, thus enabling those skilled in the art, without undue experimentation, to identify and isolate related human receptor subunits. Functional glutamate receptors can be assembled, in accordance with the present invention, from a plurality of one type of NMDA receptor subunit protein (homomeric) or from a mixture of two or more types of subunit proteins (heteromeric). In addition to disclosing novel NMDA receptor protein subunits, the present invention also comprises methods for using such receptor subunits to identify and characterize compounds which affect the function of such receptors, e.g., agonists, antagonists, and modulators of glutamate receptor function. The invention also comprises methods for determining whether unknown protein(s) are functional as NMDA receptor subunits.

3 Claims, 7 Drawing Sheets

OTHER PUBLICATIONS

Abbott, NMDA receptor subunit cloned, *Trends Pharmacol. Sci. 12:*334 (1991).

Abe et al., Molecular characterization of a novel metabotropic glutamate receptor mGluR5 coupled to inositol phosphate/$Ca^{2+}$ signal transduction, *J. Biol. Chem. 267:*13361–13368 (1992).

Albin et al., Abnormalities of striatal projection neurons and N–methyl–D–aspartate receptors in presymptomatic Huntington's Disease, *N. Engl. J. Med. 322(18):*1293–1298 (1990).

Anantharam et al., Combinatorial RNA splicing alters the surface charge on the NMDA receptor, *FEBS Lett. 305(1):*27–30 (1992).

Bahouth et al., Immunological approaches for probing receptor structure and function, *Trends Pharmacol. Sci. 12:*338–343 (1991).

Barnard, Will the real NMDA receptor please stand up? *Trends Pharmacol. Sci. 13:*11–12 (1992).

Beal, Mechanisms of excitotoxicity in neurologic diseases, *FASEB J. 6:*3338–3344 (1992).

Ben–Ari et al., Protein kinase C modulation of NMDA currents: an important link for LTP induction, *Trends Neurosci. 15:*333–339 (1992).

Black et al., N–methyl–D–aspartate– or glutamate–mediated toxicity in cultured rat cortical rat cortical neurons is antagonized by FPL 15896AR, *J. Neurochem. 65:*2170–2177 (1995).

Bottaro et al, Identification of the hepatocyte growth factor receptor as the c–met proto–oncogene product, *Science 251:*802–804 (1991).

Bradford, A rapid and sensitive method for the quantitation of microgram quantities of protein utilizing the principle of protein–dye binding, *Anal. Biochem. 72:*248 (1976).

Bristow et al., The glycine/NMDA receptor antagonist R–(+)–HA–966, blocks actvation of the mesolimbic dopaminergic system induced by phencyclidine and dizcilpine (MK–801) in rodents, *Br. J. Pharmacol. 108:*1156–1163 (1993).

Choi, Calcium–mediated neurotoxicity: Relationship to specific channel types and role in ischemic damage, *Trends Neurosci. 11(10):*465469 (1988).

Choi, Glutamate neurotoxicity and diseases of the nervous system, *Neuron 1:*623–634 (1988).

Ciba–Geigy Unveils Research Agreement with SIBIA of U.S., *The Wall Street Journal* (Sep. 17, 1992).

Coyle et al., Oxidative stress, glutamate, and neurodegenerative disorders, *Science 262:*689–695 (1993).

Daggett et al., Cloning and functional characterization of three splice variants of the human NMDAR1 receptor, *Biophys J., 36(2):*447 (1994).

Dascal, The use of Xenopus oocytes for the study of ion channels, *CRC Critical Reviews in Biochemistry 22(4):*317–387 (1987).

Donnelly and Pallotta, Single–channel currents from diethylpyrocarbonate–modified NMDA receptors in cultured rat brain cortical neurons,*J. Gen. Physol. 105:*837–859 (1995).

Durand et al., Cloning of an apparent splice variant of the rat N–methyl–D–aspartate receptor NMDAR1 with altered sensitivity to polyamines and activators of protein kinase C, *Proc. Natl. Acad. Sci. USA 89:*9359–9363 (1992).

Egebjerg et al., Intron sequence directs RNA editing of the glutamate receptor subunit GluR2 coding sequence, *Proc. Natl. Acad. Sci. USA 91:*10270–10274 (1994).

Felder et al., A transfected m1 muscarinic acetylcholine receptor stimulates adenylate cyclase via phosphatidylinisitol hydrolysis, *J. Biol. Chem. 264:*20356–20362 (1989).

Fisher and Aronson, Characterization of the cDNA and genomic sequence of a G protein γ subunit ($\gamma_5$), *Mol. Cell. Bio. 12:*1585 (1992).

Foldes et al., Cloning and sequence analysis of cDNAs encoding human hippocampus N–methyl–D–aspartate receptor subunits: Evidence for alternative splicing, *Gene 131:*293–298 (1993).

Gautam et al., A G protein gamma subunit shares homology with ras proteins, *Science 244:*971 (1989).

Gautam et al., G protein diversity is increased by associations with a variety of γ subunits, *Proc. Natl. Acad. Sci. USA 87:*7973 (1990).

Gereau and Conn, Multiple presynaptic metabotropic glutamate receptors modulate excitatory and inhibitory synaptic transmission in hippocampal area CA1, *J. Neurosci 15(10):*6879–6889 (1995).

Greenamyre et al., Synaptic localization of striatal NMDA, quisqualate and kainate receptors, *Neurosci. Lett. 101:*133–137 (1989).

Grimwood et al., Interactions between the glutamate and glycine recognition sites of the N–methyl–D–aspartate receptor from rat brain, as revealed from radioligand binding studies, *J. Neurochem. 60:*1729–1738 (1993).

Gubler et al., A simple and very efficient method for generating cDNA libraries, *Gene 25:*263–269 (1983).

Gunasekar et al., NMDA receptor activation produces concurrent generation of nitric oxide and reactive oxygen species: Implication for cell death, *J. Neurochem. 65:*2016–2021 (1995).

Gundersen et al., Glutamate and kainate receptors induced by rat brain messenger RNA in Xenopus oocytes, *Proc. R. Soc. London Ser. 221:*127 (1984).

Hess et al., Cloning, functional expression, and pharmacological characterization of human NMDAR1/NMDAR2 heteromeric receptors, *Biophys J., 36(2):*446 (1994) (abstract and poster).

Hess et al., Biophysical properties of human NMDA receptors stably expressed in mammalian cells, *Soc. Neurosci. Abstr.* 21:1–3 (1995).

Hoffman, NMDA receptor cloned—twice! *Science 254:*801–802 (1991).

Hollman et al., Zinc potentiates agonist–induced currents at certain splice variants of the NMDA receptor, *Neuron 10:*943–954 (1993).

Hollman et al., Cloned glutamate receptors, *Annu. Rev. Neurosci. 17:*31–108 (1994).

Hurley et al., Isolation and characterization of a cDNA clone for the γ subunit of bovine retinal transducin, *Proc. Natl. Acad. Sci. USA 81:*6948 (1984).

Ishii et al., Molecular characterization of the family of the N–methyl–D–aspartate receptor subunits, *J. Biol. Chem.* 268(4):2836–2843 (1993).

Ito et al., Characterization of prostaglandin $E_2$–induced $CA^{2+}$ mobilization in single bovine adrenal chromaffin cells by digital image microscopy, *J. Neurochem. 56:*531–540 (1991).

Jones et al., Characterization of the binding of radioligands to the N–methyl–D–aspartate, phencyclidine, and glycine receptors in buffy coat membranes, *J. Pharmacol. Meth. 21:*161 (1989).

Kantak et al., Effects of N–methyl–D–aspartate antagonists in rats discriminating different doses of cocaine: Comparisons with direct and indirect dopamine agonists, *J. Pharmacol. Exper. Therap. 274*:657–665 (1995).

Karp et al., Molecular cloning and chromosomal localization of the key subunit of the human N–methyl–D–aspartate receptor, *J. Biol. Chem. 268*:3728–3733 (1993).

Kemp et al., Protein kinase recognition sequence motifs, *Trends Biochem. Sci. 15*:342–346 (1990).

Kishimoto et al. Studies on the phosphorylation of myelin basic protein by protein kinase C and adenosine 3':5'–monophosphate–dependent protein kinase, *J. Biol. Chem. 260*:12492–12499 (1985).

Kisselev et al., Receptor–G protein coupling is established by a conformational switch in the βγ complex, *Proc. Natl. Acad. Sci. USA 92*:9102–9106 (1995).

Kleuss et al., Selectivity in signal transduction determined by γ subunits of heterotrimeric G proteins, *Science 259*:832 (1993).

Köhr et al., NMDA receptor Channels: Subunit–specific potentiation by reducing agents, *Neuron 12*:1031–1040 (1994).

Kozak, Structural features in eukaryotic mRNAs that modulate the initiation of translation, *J. Biol. Chem. 266*:19867–19870 (1991).

Krieg and Melton, Functional messenger RNAs are produced by SP6 in vitro transcription of cloned cDNAs, *Nucleic Acids Research 12*:7057–7070 (1984).

Kumar et al., Cloning of cDNA for the glutamate–binding subunit of an NMDA receptor complex, *Nature 354*:70–73 (1991).

Kutsuwada et al., Molecular diversity of the NMDA receptor channel, *Nature 358*:36–41 (1992).

Kyte and Doolittle, A simple method for displaying the hydropathic chacter of a protein, *J. Mol. Biol. 157*:105 (1982).

Landwehrmeyer et al., NMDA receptor subunit mRNA expression by projection neurons and interneurons in rat striatum, *J. Neurosci. 15(7)*: 5297–5307 (1995).

Le Bourdellès et al., Cloning, functional coexpression, and pharmacological characterisation of human cDNAs encoding NMDA receptor NR1 and NR2A subunits, *J. Neurochem. 62*:2091–2098 (1994).

Linder and Gilman, G proteins, *Scientific American 267*:56–65 (1992).

Liu et al., Mutational analysis of the relative orientation of transmembrane helices I and VII in G protein–coupled receptors, *J. Biol. Chem. 270(3)*:19532–19539 (1995).

Lynch et al., Pharmacological chacterization of heterodimeric NMDA receptors of NR1a and 2B subunits: Differences with receptors formed from NR 1a and 2A, *J. Neurochem. 64*:1462–1468 (1995).

Masayuki, Human mRNA for key subunit of the N–methyl–D–aspartate receptor, DDBJ database (Jul. 20, 1993).

Masu et al., Sequence and expression of a metabotropic glutamate receptor, *Nature 349*:760–765 (1991).

Matsui et al., Functional comparison of D–serine and glycine in rodents: the effect on cloned NMDA receptors and the extracellular concentration, *J. Neurochemistry 65*:454–458 (1995).

Mayer, NMDA receptors cloned at last, *Nature 354*:16–17 (1991).

Meguro et al., Functional characterization of a heteromeric NMDA receptor channel expressed from cloned cDNAs, *Nature 357*:70–74 (1992).

Meldrum, Possible therapeutic applications of antagonists of excitatory amino acid neurotransmitters, *Clin. Sci. 68*:113–122 (1985).

Meldrum et al., Excitatory amino acid neurotoxicity and neurodegenerative disease, *Trends Pharmacol. Sci. 11*:379–387 (1990).

Minakami et al., The expression of two splice variants of metabotropic glutamate receptor subtype 5 in the rat brain and neuronal cells during development, *J. Neurochem. 65*:1536–1542 (1995).

Monaghan et al., The excitory amino acid receptors: Their classes, pharmacology, and distinct properties in the function of the central nervous system, *Ann. Rev. Pharmacol. Toxicol. 29*:365–402 (1980).

Monyer et al., Heteromeric NMDA receptors: Molecular and functional distinction of subtypes, *Science 256*:1217–1221 (1992).

Monyer et al., Developmental and regional expression in the rat brain and functional properties of four NMDA receptors, *Neuron 12*:529–540 (1994).

Moriyoshi et al., Molecular cloning and characterization of the rat NMDA receptor, *Nature 354*:31–37 (1991).

Nakajima et al., Direct linkage of three tachykinin receptors to stimulation of both phosphatidylinositol hydrolysis and cyclic AMP cascades in transfected Chinese hamster ovary cells, *J. Biol. Chem. 267*:2437–2442 (1992).

Nakanishi, Molecular diversity of glutamate receptors and implications for brain function, *Science 258*:597–602 (1992).

Nicoletti et al., The activation of inositol phospholipid metabolism as a signal–transducing system for excitory amino acids in primary cultures of cerebellar granule cells, *J. Neurosci. 6*:1905 (1986).

SIBIA/Ciba–Geigy agreement, *UCSD Connect* (Sep. 16, 1992).

Ogita et al., A possible role of glutathione as an endogenous agonist at the N–methyl–D–aspartate recognition domain in rat brain, *J. Neurochem. 64*:1088–1096 (1995).

Other News to Note, *BioWorld Today,* 6 (Apr. 15, 1994).

O'Connor et al., Tetanically induced LTP involves a similar increase in the AMPA and NMDA receptor components of the excitory postsynaptic current: Investigations of the involvement of mGlu receptors, *J. Neurosci. 15(3)*:2013–2020 (1995).

Paoletti and Ascher, Mechanosensitivity of NMDA receptors in cultured mouse central neurons, *Neuron 13*:645–655 (1995).

Pin et al., Alternative splicing generates metabotropic glutamate receptors inducing different patterns of calcium release in Xenopus oocytes, *Neurobiology 89*:10331–10335 (1992).

Planells–Cases et al., Molecular cloning, functional expression, and pharmacological characterization of an N–methyl–D–aspartate receptor subunit from human brain, *Proc. Natl. Acad. Sci. USA 90*:5057–5061 (1993).

Potter, Sibia to collaborate with Ciba–Geigy, *BioWorld Today 3*:1 (Sep. 17, 1992).

Reeck et al., "Homology" in proteins and nucleic acids: a terminology muddl;e and a way out of it, *Cell 50:* 667 (1987).

Rueter et al., Glutamate receptor RNA editing in vitro by enzymatic conversion of adenosine to inosine, *Science* 267:1491–1494 (1995).

Sakurada et al., Alteration of $Ca^{2+}$ permeability and sensitivity to $Mg^{2+}$ and channel blockers by a single amino acid substitution in the N–methyl–D–aspartate, *J. Biol. Chem.* 268(1):410–415 (1993).

Sambrook et al., *Molecular Cloning. A Laboratory Manual*, 2d Ed., Cold Spring Harbor Laboratory Press (1989).

Sanes et al., Use of a recombinant retrovirus to study post–implantation cell lineage in mouse embryos, *EMBO J.* 5(12):3133–3142 (1986).

Sanner et al., NMDA receptor blockade rescues Clarke's and red nucleus neurons after spinal hemisection, *J. Neurosci.* 14(11):6472–6480 (1995).

Schoepp et al., 1S,3R–ACPD–sensitive (metabotropic [$^3$H] glutamate receptor binding in membranes, *Neurosci. Lett.* 145:100 (1992).

Sills et al., [$^3$H]CGP 39653: a new N–methyl–D–aspartate antagonist radioligand with low nanomolar affinity in rat brain, *Eur. J. Pharmacol.* 192:19 (1991).

Simon et al., Diversity of G proteins in signal transduction, *Science* 252:802 (1991).

Singaram et al., Dopaminergic defect of enteric nervous system in Parkinson's disease patients with chronic constipation, *Lancet* 346:861–864 (1995).

Sladeczek et al., Glutamate stimulates inositol phosphate formation in striatal neurones, *Nature* 317:717 (1985).

Smirnova et al., Cloning a complementary DNA fragment of human brain kainate receptor, *Dokl. Akad. Nauk SSSR* 309(3):745–748 (1989).

Smirnova et al., Characterization of a presynaptic glutamate receptor, *Science* 262:430–433 (1993).

Smirnova et al., Transsynaptic expression of a presynaptic glutamate receptor during hippocampal long–term potentiation, *Science* 262:433–436 (1993).

Sommer et al., Glutamate receptor channels: novel properties and new clones, *Trends Pharmacol. Sci* 13:291 296 (1992).

Steiner et al., Radioimmunoassay for cyclic nucleotides, *J. Biol. Chem.* 247:1106–1113 (1972).

Stillman et al., Replication and supercoiling of simian virus 40DNA in cell extracts from human cells, *Mol. Cell. Biol.* 5:2051–2060 (1985).

Stühmer, Electrophysiological recording from Xenopus oocytes, *Meth. Enzymol.* 207:319–339 (1992).

Stumpo, D. et al., Identification of c–fos sequences involved in induction by insulin and phorbol esters, *J. Biol. Chem.* 263(4):1611 (1988).

Sugihara et al., Structures and properties of seven isoforms of the NMDA receptor generated by alternative splicing, *Biochem. Biophys. Res. Commun.* 185(3):826–832 (1992).

Sugiyama et al., A new type of glutamate receptor linked to inositol phospholipid metabolism, *Nature* 325:531 (1987).

Sullivan et al., Identification of two cysteine residues that are required for redox modulation of the NMDA subtype of glutamate receptor, *Neuron* 13:929–936 (1994).

Takano et al., Chromosomal localization of the $\epsilon1$, $\epsilon3$ and $\zeta1$ subunit genes of the human NMDA receptor channel, *Biochem. Biophys. Res. Commun.* 197(2):922–926 (1993).

Tamir et al., G–protein $\beta\gamma$ forms: Identity of $\beta$ and diversity of $\gamma$ subunits, *Biochemistry* 30:3929 (1991).

Tanabe et al., A family of metabotropic glutamate receptors, *Neuron* 8:169–179 (1992).

Tingley et al., Regulation of NMDA receptor phosphorylation by alternative splicing of the C–terminal domain, *Nature* 364:70–73 (1993).

Ulas et al., Selective increase of NMDA–sensitive glutamate binding in the striatum of Parkinson's disease, Alzheimer's disease, and mixed Parkinson's disease/Alzheimer's disease patients: An autoradiographic study, *J. Neurosci.* 14(11):6317–6324 (1994).

Urlaub et al., Effect of gamma rays at the dihydrofolate reductase locus: Deletions and Inversions, *Somatic Cell and Mol. Genetics* 12(6):555–566 (1986.

Varney et al., Stable expression and characterization of recombinant human dimeric NMDA receptor subtypes 1A/2A and 1A/2B in mammalian cells, *Soc. Neurosci. Abstr.*, (1995).

Vornov et al., Enhancement of NMDA receptor–mediated neurotoxicity in the hippocampal slice by depolarization and ischemia, *Brain Res.* 555:99–106 (1991).

Waechter and Baserga, Effect of methylation on expression of microinjected genes, *Proc. Natl. Acad. Sci. USA* 79:1106–1110 (1982).

Wafford et al., Preferential co–assembly of recombinant NMDA receptors composed of three different subunits, *NeuroReport* 4(12):1347–1349 (1993).

Wahlestedt et al., Antisense oligodeoxynucleotides to NMDA–R1 receptor channel protect cortical neurons from excitotoxicity and reduce focal ischaemic infarctions, *Nature* 363:260–263 (1993).

Wenzel et al., Distribution of NMDA receptor subunit proteins NR2A, 2B, 2C, and 2D in rat brain, *NeuroReport* 7:45–48 (1995).

Wigler et al., DNA–mediated transfer of the adenine phosphoribosyltransferase locus into mammalian cells, *Proc. Natl. Acad. Sci. USA* 76:1373–1376 (1979).

Wong et al., The anticonvulsant MK–801 is a potent N–methyl–D–aspartate antagonist, *Proc. Natl. Acad. Sci. USA* 83:7104 (1986).

Bledsoe et al., Molecular homology and DNA Hybridization, J. Mol. Evol. 30:425–433 (1990).

Gilbert, *Developmental Biology*, 2nd ed., Sinauer Associates, Sunderland MA, pp. 54–55 (1988).

Hess et al., Functional characterization of human N–methyl–D–aspartate subtype 1A/2D receptors, *J Neurochem* 70(3):1269–79 (1998).

Ikeda et al., Cloning and expression of the epsilon4 subunit of the NMDA receptor channel, *FEBBS Lett.* 313(1):34–38 (1992).

Jansen et al., Acutoradiographic visualisation of [3H]DTG binding to sigma receptors, [3H]TCP binding sites, and I–[3H]glutamate binding to NMDA receptors in the human cerebellum, *Neursci. Lett.* 125:143–146 (1991).

Mori et al., Involvement of the carboxyl–terminal region in modulation by TPA of the NMDA receptor channel, *Neuroreport* 4(5):519–22 (1993).

Nakanishi et al., Alternative splicing generates functionally distinct N–methyl–D–aspartate receptors, *Proc. Natl. Acad. Sci. USA* 89:8552–8556 (1992).

Shepard, *Neurobiology*, 2nd ed., Oxford University Press, New York, pp. 31, 76, 155, 157, 161 (1988).

Williams K, Pharmacological properties of recombinant N–methyl–D–aspartate (NMDA) receptors containing the epsilon 4 (NR2D) subunit, *Neurosci Lett* 184(3):181–4 (1995).

Yamakura et al., Different sensititives of NMDA receptor channel subtypes to non–competitive antagonists, *Neuroreport* 4(6):687–90 (1993).

Yakel et al., Identification of a $Ca^{2+}$/calmodulin protein kinase II regulatory phosphorylation site in N–methyl–D–aspartate glutamate receptors, *Proc. Natl. Acad. Sci. USA* 92:1376–1380 (1995).

Yamazaki, M. et al., Cloning, expression and modulation of a mouse NMDA receptor subunit *FEBS Letters 300(1)*:39 (1992).

Young et al., NMDA receptor losses in putamen from patients with Huntington's Disease, *Science 241*:981–983 (1988).

Younkin et al., Inducible expression of neuronal glutamate receptor channels in the NT2 human cell line, *Proc. Natl. Acad. Sci. USA 90*:2174–2178 (1993).

Zeevalk et al., Chemically induced hypoglycemia and anoxia: Relationship to glutamate receptor–mediated toxicity in retina, *J. Pharmacol. Exp. Thera. 253(3)*:1285–1292 (1990).

Zeevalk et al., Mechanisms underlying initiation of excitotoxicity associated with metabolic inhibition, *J. Pharmacol. Exp. Thera. 257(2)*:870–878 (1991).

Zhang et al., Spermine potentiation of recombinant N–methyl–D–aspartate receptors is affected by subunit composition, *Proc. Natl. Acad. Sci. USA 91*:10883–10887 (1994).

Zipser et al., Mapping function domains in the promoter region of the herpes thymidine kinase gene, *Proc. Natl. Acad. Sci. USA 78(10)*:6276–6280 (1981).

NUCLEOTIDE SEQUENCE OF THE HUMAN NMDAR1A RECEPTOR

```
   1  ccagccggc gttcggagct gtgccggcc ccgcttcagc accgccggaca gcgccggacg ccgccggcac gcttcagcc
 101  ccctttccctc ggccgacgtc ccgggaccgc cgctccgggg gagacgtggc gtccgcgagc cgcggggccg ggacggcccg gaagcccgc
 201  ggggatgcg ccgaggccc cgcgttcgcg ccaggcccgc ccagcccgc catgagcacc atgcgcctgc agcacgcgga gatgttccgc cctgctgttc
 301  tcctgctccg tgcccgtgc cggccgtgac ccaagatcg tcaacattgg ccccacgcc tccgtcaccgc ccaagcccaa cggcatcccg cggtttccgc gaggccgtga
 401  accaggccaa caaggccac ggctcctga agattcagct caatgccacc acaagcccaa cgccatccgg cccacttcact atggctctgt cggtgtgcga
 501  ggacctcatc tccagccagg tctacgccat cctagttagc cgcatgtcca caagagcatc ccactccactg cctgcccgac agccggcttc
 601  tacccgcatac ccgtgctggg gctgaccacc tctactccga gaaccaactc tcagcgacga ccacgaggc cggcggggctc agaaacgcct
 701  agtccaggcgt gtggtttgag atgatccgtg tctacagctg gaaccacatc tctgctctgc tcagcgacga ccacgaggc cggcggggctc agaaacgcct
        [Pvu II]
       ——— 63 bp INSERT
 801  ggagaccctg ctgagcagc gtgctccaa ggcagagaac gtgactccag ttgaccaagg gcagccggca cgccaccgg tgctgatgga gccgaagag
        [Sma I]
 901  ctggagccc ggtcatcat ccttctctgc agcgaggacg atgctgcccac acgccctgcc ctacgcccca gacggcatcc gctcatcaac gacggctcc gggtacgtgt
       [BgIII]
                                                                                                                204 bp DELETION
1001  ggctggtcgg cgagcgcgag atctcgggga acgcccctgcc ctacgcccca gacggcatcc gctcatcaac ggcaagaacc agtcggccca
1101  catccaggac gcccgtgggccg tggtgccca gcccgtgcac gagctcctcg gcttttgcat cgaacctgct gttgctacg gctttttgcat cgaacctgct aacaagacgaa catcaccgac agaaggagaa gctgcctgcg caacaccaac
1201  atctgcaaga ccggcccgct cttcaagagga gtgctgatgt cttccaagta tgccgatgcg gtgactgctc acaatggcac ccactgtgtc cctaatgaca ggaagatcat
1301  agttcgccaa ctacacgcg agaacctgc atgaaccatc aggggtccaa gtggttgcaa gtcggccatct acaatggcac ccactgtgtc cctaatgaca ggaagatcat
1401  ctgccaggc ggagacagc agaagcctcg aggggtaccag atgtccacca gactgaagat tgtgaccgat ccttcgtgta cgtcaagccc
1501  acgctgagtg atggacatg caaggagaag ttcacagtca acggcgaccg agtcaagaag gtgatctgca ccgggcccaa cgacacgtcg cgggcagcc
1601  cccgccacac ggtgcctcag cgttggctacg gcttttttgcat cgaacctgct aacaagacgaa caccctgctc tacagttcacc acgagggctc cctggtgtgc
1701  agatgccaag ttcggcacac aggagcgggt gaacacagc aacaagaagg atggaatgc gagctgctca gacatgatc tctgtcaag aaggagattc
1801  gtggcgcgc taaccataaa ctggactcg cggcagtaca tcatggcaac agcaagtacc ggctgttcgt tctgtcaag aggggagatt
1901  cccggaccac gctgacctcg cgttccagag caccactgtg gctgtccg tctgctccgg cgtgaccgg gcgtgccga aggagggctc
2001  ggaccgcttc agcccgcttc gccggttcaa ggtgaacagc gaggggagc actgaccctg tcctcggcca tgtgttctc ctgggggtc
```

FIG. 3A

```
                                                                                                    363 bp    1087 bp
                                                                                                    DELETION  DELETION
2101 CTGCTCAACT CGGCATCGG GGAAGGCGCC CCCAGAAGCT TCTCAGCGCG CATCCTGGGC ATGGTGTGG CCGGCTTTGC CATGATCATC GTGGCCTCCT
2201 ACACCCCAA CCTGGCGGCC TTCCTGGTGC GCTCCGTGGA GCTGAGCAGA TATCTACTTC CGGCAGCCC ATCACGGGCA TCAACGACCC TGGCTGAGG AACCCCTGG ACAAGTTTAT
2301 CTACGCCACG GTGAAGCAGA CCATCCAGCC CGTGAGAGAC AACAAGCTGC ATGCCTTCAT CTGGACTCG GGGTGCTGG CACCATGTAC CGGCATATGG AGAAGCACAA CTACGAGAGT
2401 GCGCGGAGG CCATCCAGCC CGTGAGAGAC AACAAGCTGC ATGCCTTCAT CTGGACTCG GGGTGCTGG AGTTCGAGCC CTCCAGAAAG TGCCACCTGG
2501 TGACGACTGG AGAGCTGTTT TTCCCCTCGG GCTTCGGCAT AGGCATGCGC AAAGACAGCC CCTGGAAGCA GAACGTCTCC CTGTCCATCC TCAAGTCCCA
2601 CGAGAATGGC TTCATGGAAG ACCTGGACAA GACGTGGGTT CGGTATCAGG AATGTGACTC GCCCAGCAAC GCCCCTGCGA CCCTTACTTT TGAGAACATG
2701 GCCGGGTCT TCATGCTGGT AGCTGGGGGC ATCGTGGCCG GGATCTTCCT GATTTTCATC GAGATTGCCT ACAAGCGGCA CAAGGATGCT CGCCGGAAGC

2801 AGATGCAGCT GGCCTTTGCC GCCGTTAACG TGTGCGGAA GAACCTGCAG GATAGAAAGA GTGCTAGAGC AGAGCCTGAC CCTAAAAAGA AAGCCACATT
2901 TAGGCCTATC ACCTCCACCC TGCCTTCCAG CTTCAAGAGG CGTAGGTCCT CCAAAGACAC GAGCACCGGG GGTGGACGCG GTGCTTTGCA AAACCAAAAA
3001 GACACAGTGC TGCCCGGACG CGCTATTGAA AGGAGGAGG GCCAGCTGCA GCTGTGTTCC CGTCATAGGG AGAG TGA gca ctccccgccc gccctcctct
3101 gcccctcccc ccgcagacaca acagacagac ggacgggaca gcgccccggc ccacgggtc ggggggag caccccagc ggggggggag cactgccac
3201 ctccccagg ctgcctgc cgtcccgcg gttgccgg tgccggtcc acccgtcc ggcccgcc gtgcccag gtgccccag cgtggggcta acgggcgct gctgagggcg
3301 tgtctgtgta tttctatttt gcagcagtac catcccactg atatcacgga ccgctcaac ctctcagatc cctcggtcag cacgtggtg t gagg ccccc
3401 ggaggcgccc acctgccag ttagccggc caaggacact gatgggtcct gctgctcgag aaggctcgg ccaaggtccg gaccggagcg gactgccac
3501 cctggcctc ccgtccgtcc gccccgccac ccctgctgcct ggggggcagc ccctgctgga ccctgctgga ccaaggtccg gaccggagcg gctgaggacg gggcagagct
3601 ggagcggctg ggcagggccg caggcgctc cggcagagc aggcgctc gccaccctg ggtctcgag cagtggggcc catgggcca gctgctggg ctgccccag ctgccccag cggagggc
3701 ttggagcaga gaccggagc ccatcttcc cgcagcacca gctgagcca gccacacgc ccccaaaca gcctccctcg gctctgacgc cacacgccgg tcgggcgct
3801 gcgctcctct gcagcctgag aggctcgtcc ctgacttccc agtggcagc gcctcccgc ctcccacct gctcctcca agctgagag ggctggcc ctcctctct
3901 gcctccccc aaggcctc ctgacttccc agtggcagc gcctcccgc ctcccacct ggctggggc tgtcttcaac cctgcccctg cagggccga gggctggcc ctcctctct
4001 cgtccggcct gcagcacaga aggggcctc cccggacgct ggctgggac ttgtacgaa ccagcactcc cagggccga gcgtgcct tccctgcg
4101 ccaccgccc gcccccgc tcgctccggg tgcctgacg tgcaggggcc caccaccgcc cagtgtatg cagtggtgat gcctaaggg cgggagagcg
4201 cagccggct ctgccctcc gtcccctcc gtcagggccg              gcctaaggga atgtcacg
```

FIG.3B

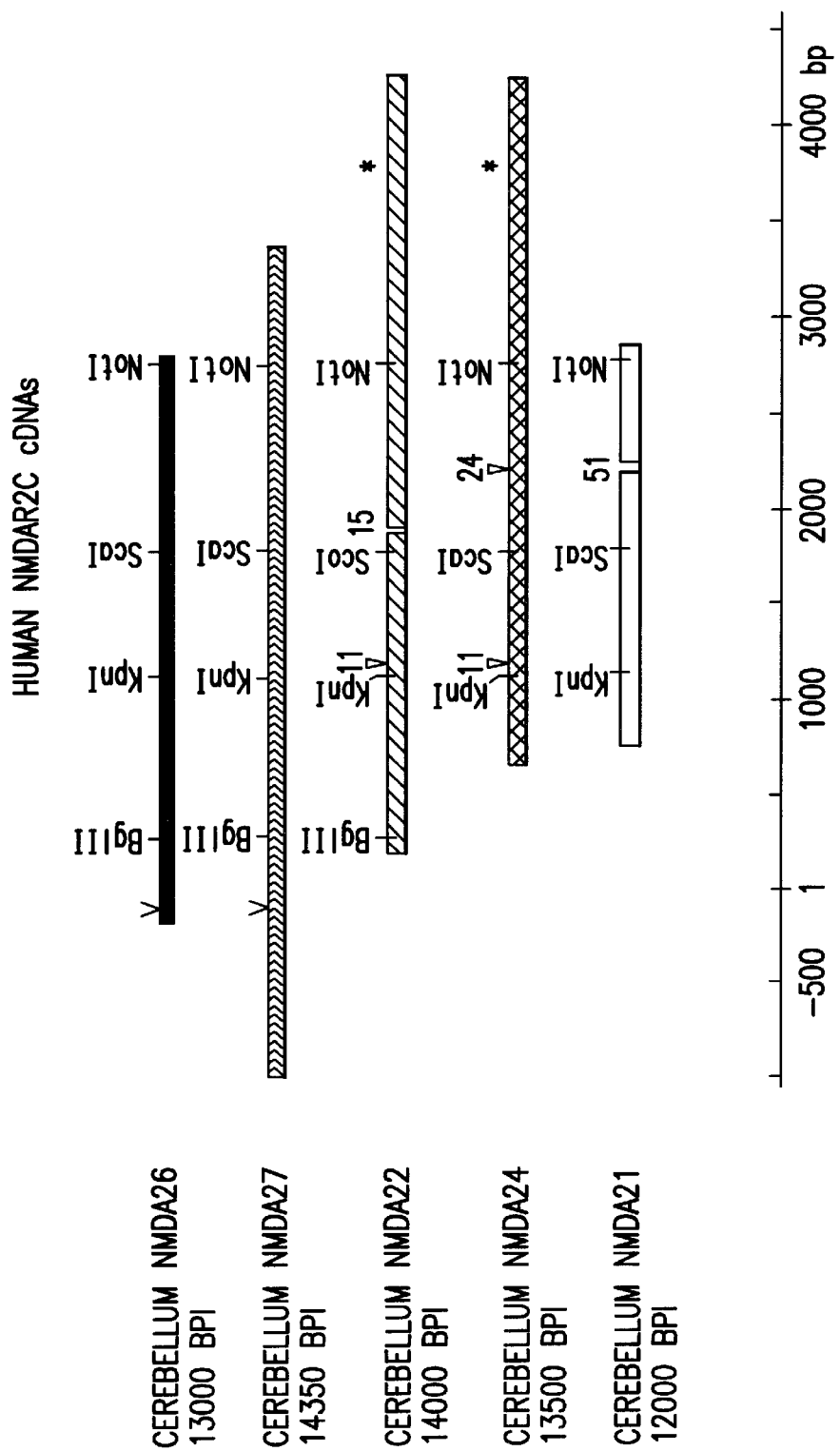

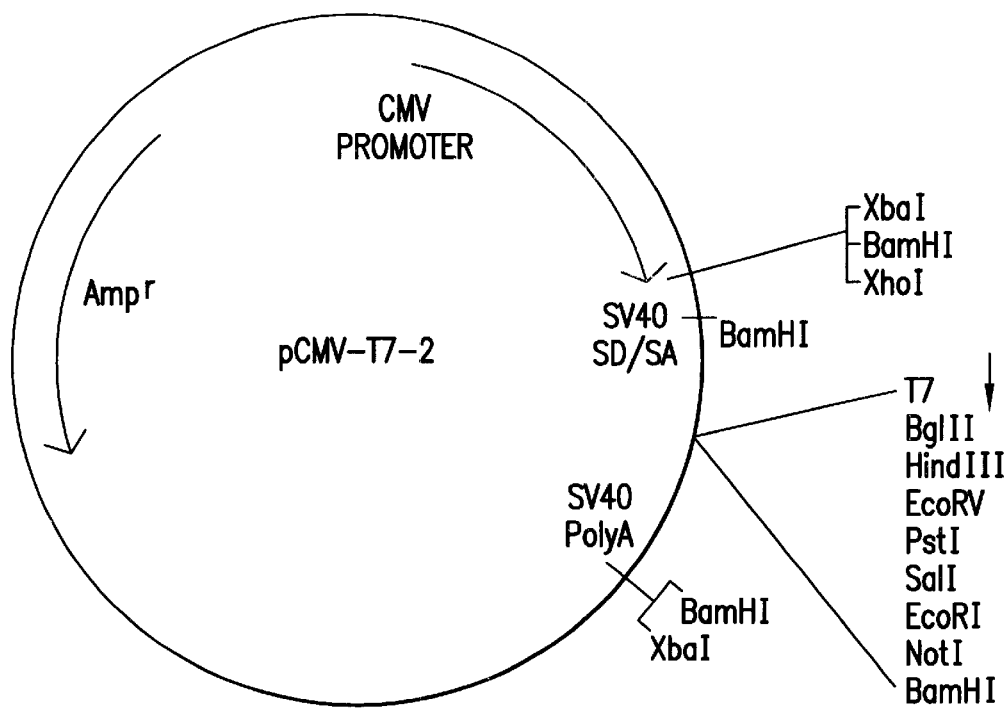
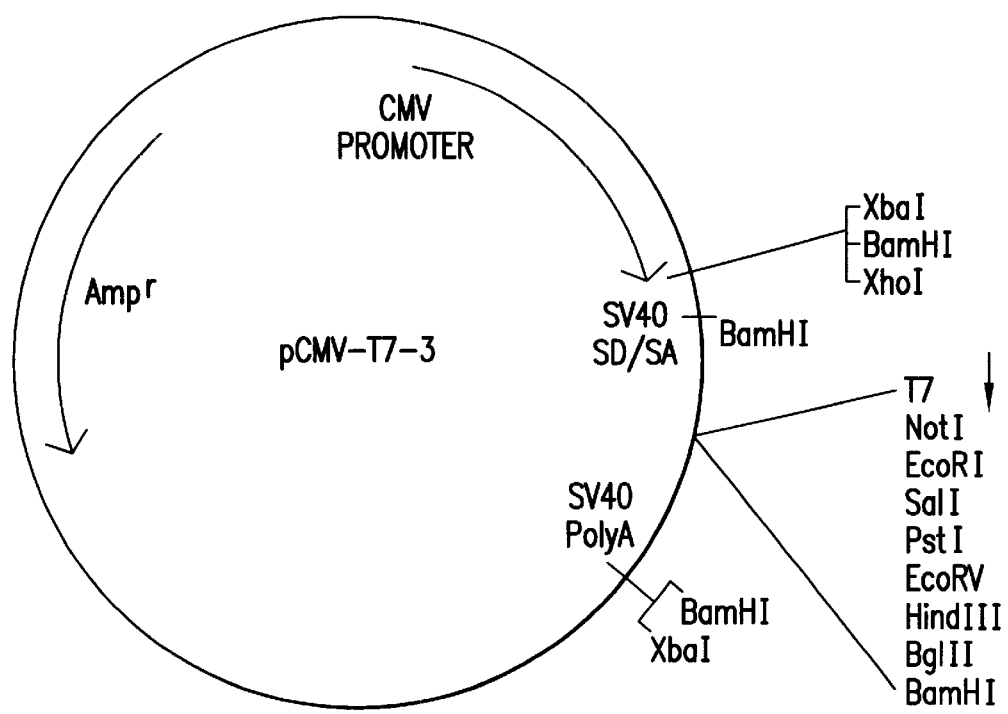
FIG.6

HUMAN N-METHYL-D-ASPARTATE RECEPTOR SUBUNITS, NUCLEIC ACIDS ENCODING SAME AND USES THEREFOR

This application is a divisional of application Ser. No. 08/940,086, filed Sep. 29, 1997, now U.S. Pat. No. 6,111,091, which is a division of application Ser. No. 08/231,193, filed Apr. 20, 1994, now U.S. Pat. No. 5,849,895, which is a continuation in part of application Ser. No. 08/052,449, filed Apr. 20, 1993, now abandoned.

The present invention relates to nucleic acids and receptor proteins encoded thereby. Invention nucleic acids encode novel human N-methyl-D-aspartate (NMDA) receptor subunits. The invention also relates to methods for making such receptor subunits and for using the receptor proteins in assays designed to identify and characterize compounds which affect the function of such receptors, e.g., agonists and antagonists of NMDA receptors.

BACKGROUND OF THE INVENTION

The amino acid L-glutamate is a major excitatory neurotransmitter in the mammalian central nervous system. Anatomical, biochemical and electrophysiological analyses suggest that glutamatergic systems are involved in a broad array of neuronal processes, including fast excitatory synaptic transmission, regulation of neurotransmitter releases, long-term potentiation, learning and memory, developmental synaptic plasticity, hypoxic-ischemic damage and neuronal cell death, epileptiform seizures, as well as the pathogenesis of several neurodegenerative disorders. See generally, Monaghan et al., Ann. Rev. Pharmacol. Toxicol. 29:365–402 (1980). This extensive repertoire of functions, especially those related to learning, neurotoxicity and neuropathology, has stimulated recent attempts to describe and define the mechanisms through which glutamate exerts its effects.

Currently, glutamate receptor classification schemes are based on pharmacological criteria. Glutamate has been observed to mediate its effects through receptors that have been categorized into two main groups: ionotropic and metabotropic. Ionotropic glutamate receptors contain integral cation-specific, ligand-gated ion channels, whereas metabotropic glutamate receptors are G-protein-coupled receptors that transduce extracellular signals via activation of intracellular second messenger systems. Ionotropic receptors are further divided into at least two categories based on the pharmacological and functional properties of the receptors. The two main types of ionotropic receptors are N-methyl-D-aspartic acid (NMDA) and kainic acid (KA)/α-amino-3-hydroxy-5-methyl-isoxazole-4-propionic acid (AMPA), formerly called the quisqualic acid, or QUIS, receptor. While the metabotropic receptors bind to some of the same ligands that bind to ionotropic glutamate receptors, the metabotropic receptors alter synaptic physiology via GTP-binding proteins and second messengers such as cyclic AMP, cyclic GMP, diacylglycerol, inositol 1,4,5-triphosphate and calcium [Gundersen et al., Proc. R. Soc. London Ser. 221:127 (1984); Sladeczek et al., Nature 317:717 (1985); Nicoletti et al., J. Neurosci. 6:1905 (1986); Sugiyama et al., Nature 325:531 (1987)].

The electrophysiological and pharmacological properties of the glutamate receptors have been studied using animal tissues and cell lines, as well as recombinantly produced non-human receptors, as the source of such receptors. The value of such studies for application to the development of human therapeutics has been limited by the availability of only non-human receptor subunits. Moreover, it is only recently that the characteristics and structure of glutamate receptors have been investigated at the molecular level. The majority of such investigation has, however, been carried out in non-human species. Because of the potential physiological and pathological significance of glutamate receptors, it would be desirable (for example, for drug screening assays) to have available human sequences (i.e., DNA, RNA, proteins) which encode representative members of the various glutamate receptor subtypes. The availability of such human sequences will also enable the investigation of receptor distribution in humans, the correlation of specific receptor modification with the occurrence of various disease states, etc.

BRIEF DESCRIPTION OF THE INVENTION

The present invention discloses novel nucleic acids encoding NMDA receptor protein subunits and the proteins encoded thereby. In a particular embodiment the novel nucleic acids encode NMDAR1 and NMDAR2 subunits of human NMDA receptors. More specifically, the invention nucleic acids encode NMDAR1, NMDAR2A, NMDAR2B, NMDAR2C and NMDAR2D subunits that contribute to the formation of NMDA-activated cation-selective ion channels. In addition to being useful for the production of NMDA receptor subunit proteins, these nucleic acids are also useful as probes, thus enabling those skilled in the art, without undue experimentation, to identify and isolate nucleic acids encoding related receptor subunits.

Functional glutamate receptors can be assembled, in accordance with the present invention, from a plurality of NMDA receptor subunit proteins of one type (homomeric) or from combinations of subunit proteins of different types (heteromeric).

In addition to disclosing novel NMDA receptor protein subunits, the present invention also comprises methods for using such receptor subunits to identify and characterize compounds which affect the function of such receptors, e.g., agonists, antagonists, and modulators of glutamate receptor function. The invention also comprises methods for determining whether unknown protein(s) are functional as NMDA receptor subunits.

BRIEF DESCRIPTION OF THE FIGURES

FIG. 3 presents the entire nucleotide sequence of construct NMDAR1A (see Sequence ID No. 1) with the following information added for ease of comparison of the splice variations of the NMDAR1 subunit transcript: lowercase letters indicate 5' untranslated sequence and the 3' untranslated sequence of the NMDAR1 splice variant shown in Sequence ID No. 1 (in some of the other splice variants, this 3' untranslated sequence is actually coding sequence); uppercase letters indicate coding sequence; the translation initiation codon is identified by the word "START" whereas the three different translation termination codons (TGA) used in the different splice variants are identified by small boxes; significant restriction enzyme sites used in preparing full-length variant constructs are identified by name above the sites; the location of a 63-bp insertion (see Sequence ID No. 3) that exists in some of the variants is marked as "63 bp INSERT"; the nucleotide sequences that are deleted from some of the variants are boxed and labeled as "204 bp DELETION," "363 bp DELETION," and "1087 bp DELETION."

FIG. 4 is a schematic representation of various human NMDAR2C clones of the invention, with partial restriction maps of each clone. The clones are aligned and the differences in the DNAs relative to clone NMDA26 are indicated in the same manner as done in FIG. 1.

FIG. 6 presents restriction maps of CMV promoter-based vectors pCMV-T7-2 and pCMV-T7-3.

DETAILED DESCRIPTION OF THE INVENTION

Figure 1:
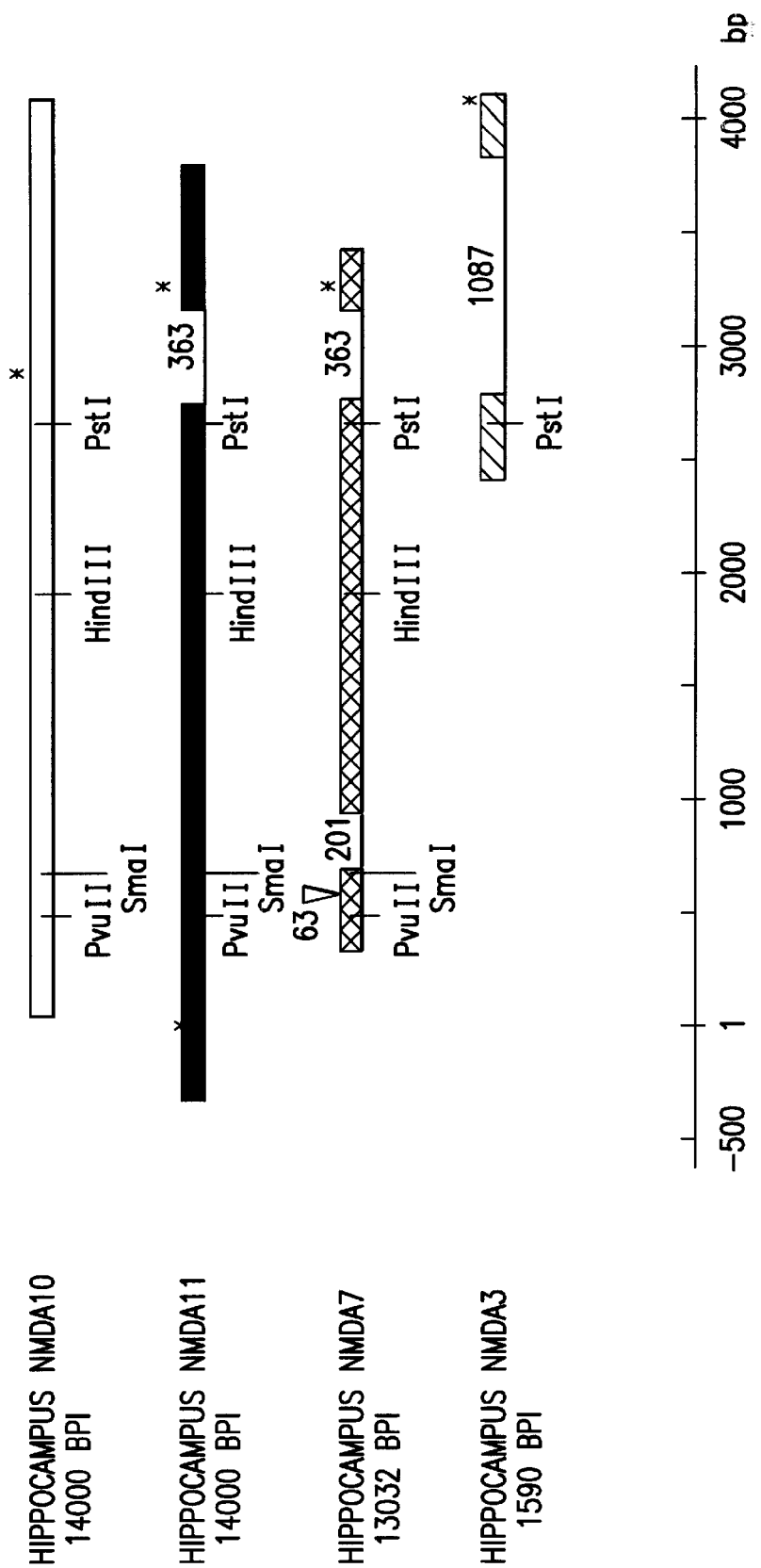
FIG. 1 is a schematic representation of various human NMDAR1 clones of the invention, with partial restriction maps of each clone. The clones are aligned and the differences in the DNAs (i.e., deletions and insertions), relative to clone NMDA10, are indicated. Translation initiation and termination sites are represented by a "V" and a "*", respectively. Insertions are marked as inverted triangles, deletions are indicated by spaces in the boxes. The numbers above the insertions and deletions refer to the number of nucleotides inserted or deleted relative to NMDA10.

In accordance with the present invention, there are provided isolated nucleic acids encoding human N-methyl-D-aspartate (NMDA) receptor subunit(s). In one aspect of the present invention, nucleic acids encoding NMDA receptor subunit(s) of the NMDAR1 subtype are provided. In another aspect, nucleic acids encoding NMDA receptor subunit(s) of the NMDAR2 subtype are provided. In a further aspect, eukaryotic cells containing such nucleic acids, and eukaryotic cells expressing such nucleic acids are provided.

Also provided are protein(s) encoded by the above-described nucleic acids, as well as antibodies generated against the protein(s). In other aspects of the present invention, there are provided nucleic acid probes comprising at least NMDA receptor subunit-selective portions of the above-described nucleic acids.

As employed herein, the phrase "human N-methyl-D-aspartate (NMDA) receptor subunit(s)" refers to recombinantly produced (i.e., isolated or substantially pure) proteins which participate in the formation of a voltage-sensitive cation-selective channel activated by exposure to NMDA, and having at least one transmembrane domain, a large N-terminal extracellular domain, and the like, including variants thereof encoded by mRNA generated by alternative splicing of a primary transcript, and further including fragments thereof which retain one or more of the above properties.

Use of the phrase "recombinantly produced", "isolated" or "substantially pure" in the present specification and claims as a modifier of DNA, RNA, polypeptides or proteins means that the DNA, RNA, polypeptides or proteins so designated have been produced in such form by the hand of man, and thus are separated from their native in vivo cellular environment. As a result of this human intervention, the recombinant DNAs, RNAs, polypeptides and proteins of the invention are useful in ways that the DNAs, RNAs, polypeptides or proteins as they naturally occur are not, such as identification of selective drugs or compounds.

The term "functional", when used herein as a modifier of receptor protein(s) of the present invention, means that binding of NMDA (or NMDA-like) ligand to receptors comprising the protein(s) causes the receptor "ion channels" to open. This allows cations, particularly $Ca^{2+}$, as well as $Na^+$ and $K^+$, to move across the membrane. Stated another way, "functional" means that a signal is generated as a consequence of agonist activation of receptor protein(s).

As used herein, a splice variant refers to variant NMDA receptor subunit-encoding nucleic acid(s) produced by differential processing of primary transcript(s) of genomic DNA, resulting in the production of more than one type of mRNA. cDNA derived from differentially processed primary transcript will encode NMDA receptor subunits that have regions of complete amino acid identity and regions having different amino acid sequences. Thus, the same genomic sequence can lead to the production of multiple, related mRNAs and proteins. Both the resulting mRNAs and proteins are referred to herein as "splice variants".

Accordingly, also contemplated within the scope of the present invention are DNAs that encode NMDA receptor subunits as defined above, but that by virtue of degeneracy of the genetic code do not necessarily hybridize to the disclosed DNA under specified hybridization conditions. Such subunits also contribute to the formation of functional receptor, as assessed by methods described herein or known to those of skill in the art, with one or more additional NMDA receptor subunits of the same or different type (the presence of additional subunits of a different type is optional when said subunit is an NMDAR1 subunit). Typically, unless an NMDA receptor subunit is encoded by RNA that arises from alternative splicing (i.e., a splice variant), NMDA receptor subunit-encoding DNA and the NMDA receptor subunit encoded thereby share substantial sequence homology with at least one of the NMDA receptor subunit DNAs (and proteins encoded thereby) described herein. It is understood that DNA or RNA encoding a splice variant may share less than 90% overall sequence homology with the DNA or RNA provided herein, but include regions of nearly 100% homology to a DNA fragment described herein, and encode an open reading frame that includes start and stop codons and encodes a functional NMDA receptor subunit.

As employed herein, the phrase "NMDA receptor subunit (s) of the NMDAR1 subtype" refers to proteins which, by hydrophobicity analysis of deduced amino acid sequences, are believed to contain four or more putative transmembrane domains, preceded by a large extracellular N-terminal domain. The amino acid sequence typically contains possible phosphorylation sites for $Ca^{2+}$/calmodulin-dependent protein kinase type II and protein kinase C [see, for example, Kemp et al. (1990) Trends in Biological Science Vol. 15:342–346; Kishimoto et al. (1985) J. Biol. Chem. Vol. 260:12492–12499; Whittemore et al. (1993) Nature 364:70–73]. (These protein kinases reportedly play a crucial role in induction and maintenance of long term potentiation.)

The putative TMII segment (i.e., second transmembrane domain) is typically flanked by a glutamic acid residue at the extracellular side and a stretch of glutamic acid residues at the cytoplasmic side. This segment contains an asparagine residue believed to be responsible for high $Ca^{2+}$ permeability of the NMDAR channel. For a summary of NMDAR properties, see Ben-Ari et al., in TINS 15:333–339 (1992), especially at p. 334.

Exemplary DNA sequences encoding human NMDAR1 subunits are represented by nucleotides which encode substantially the same amino acid sequence as set forth in Sequence ID Nos. 2, 20, 22, 24, 26, 28, 30, 32, 34, 36, 38 or 40. Presently preferred sequences encode substantially the same amino acid sequence as set forth in Sequence ID Nos. 2, 20, 22, 24, 26, 28 or 40.

Exemplary DNA can alternatively be characterized as those nucleotide sequences which encode a human NMDAR1 subunit and hybridize under high stringency conditions to substantially the entire sequence of any one of Sequence ID Nos. 1, nucleotides 320-3402 of Sequence ID No. 1, or Sequence ID Nos. 13, 15, 17, 19, 21, 23, 25, 27, 29, 31, 33, 35, 37, or 39, or substantial portions thereof (i.e., typically at least 25–30 nucleotides thereof); preferably exemplary DNA will hybridize under high stringency conditions to substantially the entire sequence of any one of Sequence ID Nos. 1, 19, 21, 23, 25, 27 or 39, or substantial portions thereof.

Stringency of hybridization is used herein to refer to conditions under which polynucleic acid hybrids are stable. As known to those of skill in the art, the stability of hybrids is reflected in the melting temperature ($T_m$) of the hybrids. $T_m$ can be approximated by the formula:

$$81.5° C.-16.6(\log_{10}[Na^+])+0.41(\%G+C)-600/l,$$

where l is the length of the hybrids in nucleotides. $T_m$ decreases approximately 1–1.5° C. with every 1% decrease in sequence homology. In general, the stability of a hybrid is a function of sodium ion concentration and temperature. Typically, the hybridization reaction is performed under conditions of lower stringency, followed by washes of varying, but higher, stringency. Reference to hybridization stringency relates to such washing conditions. Thus, as used herein:

(1) HIGH STRINGENCY conditions, with respect to fragment hybridization, refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in 50% formamide, 5×Denhart's solution, 5×SSPE, 0.2% SDS at 42° C., followed by washing in 0.1×SSPE, and 0.1% SDS at 65° C.;

(2) MODERATE STRINGENCY conditions, with respect to fragment hybridization, refers to conditions equivalent to hybridization in 50% formamide, 5×Denhart's solution, 5×SSPE, 0.2% SDS at 42° C., followed by washing in 0.2×SSPE, 0.2% SDS, at 65° C.;

(3) LOW STRINGENCY conditions, with respect to fragment hybridization, refers to conditions equivalent to hybridization in 10% formamide, 5×Denhart's solution, 6×SSPE, 0.2% SDS at 42° C., followed by washing in 1×SSPE, 0.2% SDS, at 50° C.; and (4) HIGH STRINGENCY conditions, with respect to oligonucleotide (i.e., synthetic DNA≦about 30 nucleotides in length) hybridization, refers to conditions equivalent to hybridization in 10% formamide, 5×Denhart's solution, 6×SSPE, 0.2% SDS at 42° C., followed by washing in 1×SSPE, and 0.2% SDS at 50° C.

It is understood that these conditions may be duplicated using a variety of buffers and temperatures and that they are not necessarily precise.

Denhart's solution and SSPE (see, e.g., Sambrook, Fritsch, and Maniatis, in: *Molecular Cloning, A Laboratory Manual*, Cold Spring Harbor Laboratory Press, 1989) are well known to those of skill in the art as are other suitable hybridization buffers. For example, SSPE is pH 7.4 phosphate-buffered 0.18M NaCl. SSPE can be prepared, for example, as a 20×stock solution by dissolving 175.3 g of NaCl, 27.6 g of $NaH_2PO_4$ and 7.4 g EDTA in 800 ml of water, adjusting the pH to 7.4, and then adding water to 1 liter. Denhart's solution (see, Denhart (1966) Biochem. Biophys. Res. Commun. 23:641) can be prepared, for example, as a 50×stock solution by mixing 5 g Ficoll (Type 400, Pharmacia LKB Biotechnology, INC., Piscataway, N.J.), 5 g of polyvinylpyrrolidone, 5 g bovine serum albumin (Fraction V; Sigma, St. Louis, Mo.) water to 500 ml and filtering to remove particulate matter.

Especially preferred sequences are those which have substantially the same nucleotide sequence as the coding sequences in any one of Sequence ID Nos. 1, 19, 21, 23, 25, 27, 29, 31, 33, 35, 37 or 39; with those having substantially the same sequence as the coding sequence in Sequence ID Nos. 1, 19, 21, 23, 25, 27 or 39 being most preferred.

As used herein, the phrase "substantial sequence homology" refers to nucleotide sequences which share at least about 90% identity, and amino acid sequences which typically share more than 95% amino acid identity (>99% amino acid identity when dealing with NMDAR1 subunits). It is recognized, however, that proteins (and DNA or mRNA encoding such proteins) containing less than the above-described level of homology arising as splice variants or that are modified by conservative amino acid substitutions (or substitution of degenerate codons) are contemplated to be within the scope of the present invention.

As used herein, the phrase "substantially the same" refers to the nucleotide sequences of DNA, the ribonucleotide sequences of RNA, or the amino acid sequences of protein, that have slight and non-consequential sequence variations from the actual sequences disclosed herein. Species that are "substantially the same" are considered to be equivalent to the disclosed sequences, and as such are within the scope of the appended claims. In this regard, "slight and non-consequential sequence variations" mean that sequences that are substantially the same as the DNA, RNA, or proteins disclosed and claimed herein, are functionally equivalent to the human-derived sequences disclosed and claimed herein. Functionally equivalent sequences will function in substantially the same manner to produce substantially the same compositions as the human-derived nucleic acid and amino acid compositions disclosed and claimed herein. In particular, functionally equivalent DNAs encode human-derived proteins that are the same as those disclosed herein or that have conservative amino acid variations, such as substitution of a non-polar residue for another non-polar residue or a charged residue for a similarly charged residue. These changes include those recognized by those of skill in the art as those that do not substantially alter the tertiary structure of the protein.

As employed herein, the phrase "NMDA receptor subunit (s) of the NMDAR2 subtype" refers to proteins which have a large putative extracellular domain at the amino-terminal region. Otherwise, the deduced structure of NMDAR2 subunits displays the same general characteristics as the NMDAR1 subunit structure. A notable typical exception is that the negatively charged glutamic acid residues that are generally present in the putative TMII segment of NMDAR1 subunits are generally absent from the TMII segment of NMDAR2. Instead, NMDAR2 subunits may contain a positively charged lysine residue in TMII. Unlike NMDAR1 subunits, NMDAR2 subunits generally do not form homomeric NMDA receptors. Moreover, the amino acid sequences of NMDAR1 and NMDAR2 subunits are generally less than 50% identical, with identities of less than 30% typically observed.

NMDAR2 subunits contemplated by the present invention include NMDAR2A, NMDAR2B, NMDAR2C and NMDAR2D types of subunits. Exemplary DNA sequences encoding human NMDAR2A subunits, or portions thereof, are represented by nucleotides which encode substantially the same amino acid sequence as set forth in Sequence ID No. 11, or substantially the same amino acid sequence as that encoded by the NMDAR2A-encoding portion of clone NMDA57, deposited with the ATCC under accession number 75442.

The deposited clone has been deposited at the American Type Culture Collection (ATCC), 12301 Parklawn Drive, Rockville, Md., U.S.A. 20852, under the terms of the Budapest Treaty on the International Recognition of Deposits of Microorganisms for Purposes of Patent Procedure and the Regulations promulgated under this Treaty. Samples of the deposited material are and will be available to industrial property offices and other persons legally entitled to receive them under the terms of the Treaty and Regulations and otherwise in compliance with the patent laws and regulations of the United States of America and all other nations or international organizations in which this application, or an application claiming priority of this application, is filed or in which any patent granted on any such application is granted. In particular, upon issuance of a U.S. patent based on this or any application claiming priority to or incorporating this application by reference thereto, all restriction upon availability of the deposited material will be irrevocably removed.

Exemplary human NMDAR2A subunit-encoding DNAs can alternatively be characterized as those nucleotide sequences which hybridize under high stringency conditions to substantially the entire sequence of Sequence ID No. 10, or substantial portions thereof (i.e., typically at least 25-30 nucleotides thereof), or the NMDAR2A-encoding portion of clone NMDA57 (ATCC accession No. 75442). Especially preferred sequences encoding human NMDAR2A subunits are those which have substantially the same nucleotide sequence as the coding sequence of Sequence ID No. 10, or those which contain substantially the same nucleotide sequence as the coding sequence in the NMDAR2A-encoding portion of clone NMDA57.

Exemplary DNA sequences encoding human NMDAR2B subunits are represented by nucleotides which encode substantially the same amino acid sequence as set forth in Sequence ID No. 56. Exemplary DNAs can alternatively be characterized as those nucleotide sequences which encode a human NMDAR2B subunit and hybridize under high stringency conditions to substantially the entire sequence of Sequence ID No. 53, or substantial portions thereof (i.e., typically at least 25–30 nucleotides thereof). Especially preferred NMDAR2B-encoding sequences are those which have substantially the same nucleotide sequence as the coding sequence in Sequence ID No. 55.

Exemplary DNA sequences encoding human NMDAR2C subunits are represented by nucleotides which encode substantially the same amino acid sequence as set forth in Sequence ID Nos. 6, 46, 48, 50, 52 or 54.

Exemplary DNAs can alternatively be characterized as those nucleotide sequences which encode a human NMDAR2C subunit and hybridize under high stringency conditions to substantially the entire sequence of any one of Sequence ID Nos. 5, 41, 43 or 44 or nucleotides 1-3025 of Sequence ID No. 5 or Sequence ID Nos. 45, 47, 49, 51 or 53, or substantial portions thereof (i.e., typically at least 25–30 nucleotides thereof); preferably exemplary DNA will hybridize under high stringency conditions to substantially the entire sequence of any one of Sequence ID Nos. 5, 45, 47 or 49, or substantial portions thereof.

Especially preferred NMDAR2C-encoding sequences are those which have substantially the same nucleotide sequence as the coding sequences in any one of Sequence ID Nos. 5, 45, 47, 49, 51 or 53; with those having substantially the same sequence as the coding sequences in Sequence ID Nos. 5, 45, 47 or 49 being most preferred.

Exemplary DNA sequences encoding human NMDAR2D subunits are represented by nucleotides which encode substantially the same amino acid sequence as set forth in Sequence ID No. 58. Exemplary DNAs can alternatively be characterized as those nucleotide sequences which encode a human NMDAR2D subunit and hybridize under high stringency conditions to substantially the entire sequence of Sequence ID No. 57, or substantial portions thereof (i.e., typically at least 25–30 nucleotides thereof). Especially preferred NMDAR2D-encoding sequences are those which have substantially the same nucleotide sequence as the coding sequence in Sequence ID No. 57.

DNA encoding human NMDA receptor subunits may be isolated by screening suitable human cDNA or human genomic libraries under suitable hybridization conditions with DNA disclosed herein (including nucleotides derived from any of SEQ ID No. 1, nucleotides 320-3402 of Sequence ID No. 1, Sequence ID Nos. 13, 15, 17, 19, 21, 23, 25, 27, 29, 31, 33, 35, 37, 39, 5, 41, 43 or 44, nucleotides 1-3025 of Sequence ID No. 5 or Sequence ID Nos. 45, 47, 49, 51, 53, 10, 55 or 57. Suitable libraries can be prepared from neuronal tissue samples, e.g., hippocampus and cerebellum tissue, cell lines, and the like. For example, the library can be screened with a portion of DNA including substantially the entire subunit-encoding sequence thereof, or the library may be screened with a suitable probe.

As used herein, a probe is single-stranded DNA or RNA that has a sequence of nucleotides that includes at least 14 contiguous bases that are the same as (or the complement of) any 14 or more contiuous bases set forth in any of SEQ ID No. 1, nucleotides 320-3402 of Sequence ID No. 1, Sequence ID Nos. 13, 15, 17, 19, 21, 23, 25, 27, 29, 31, 33, 35, 37, 39, 5, 41, 43 or 44, nucleotides 1-3025 of Sequence ID No. 5 or Sequence ID Nos. 45, 47, 49, 51, 53, 10, 55 or 57. Preferred regions from which to construct probes include 5' and/or 3' coding sequences, sequences predicted to encode transmembrane domains, sequences predicted to encode cytoplasmic loops, signal sequences, NMDA binding sites, and the like.

Either the full-length cDNA clones or fragments thereof can be used as probes, preferably labeled with suitable label means for ready detection. When fragments are used as probes, preferably the DNA sequences will be from the carboxyl end-encoding portion of the DNA, and most preferably will include predicted transmembrane domain-encoding portions of the DNA sequence (the domains can be predicted based on hydropathy analysis of the deduced amino acid sequence using, for example, the method of Kyte and Doolittle (1982), *J. Mol. Biol.* Vol. 157:105). These probes can be used, for example, for the identification and isolation of additional members of the glutamate receptor family.

As a particular application of the invention sequences, genetic screening can be carried out using the nucleotide sequences of the invention as probes. Thus, nucleic acid samples from patients having neuropathological conditions suspected of involving alteration/modification of any one or more of the glutamate receptors can be screened with appropriate probes to determine if any abnormalities exist with respect to any of the endogenous glutamate receptors. Similarly, patients having a family history of disease states related to glutamate receptor dysfunction can be screened to determine if they are also predisposed to such disease states.

In accordance with another embodiment of the present invention, there is provided a method for identifying DNA encoding human N-methyl-D-aspartate (NMDA) receptor protein subunit(s), said method comprising:

contacting human DNA with a nucleic acid probe as described above, wherein said contacting is carried out under high stringency hybridization conditions, and identifying DNA(s) which hybridize to said probe.

After screening the library, positive clones are identified by detecting a hybridization signal; the identified clones are characterized by restriction enzyme mapping and/or DNA sequence analysis, and then examined, by comparison with the sequences set forth herein to ascertain whether they include DNA encoding a complete NMDA receptor subunit (i.e., if they include translation initiation and termination codons). If the selected clones are incomplete, they may be used to rescreen the same or a different library to obtain overlapping clones. If the library is genomic, then the overlapping clones may include exons and introns. If the library is a cDNA library, then the overlapping clones will include an open reading frame. In both instances, complete clones may be identified by comparison with the DNA and encoded proteins provided herein.

Complementary DNA clones encoding various human NMDA receptor subunits (e.g., NMDAR1, NMDAR2A, NMDAR2B, NMDAR2C, NMDAR2D) have been isolated. Each type of subunit appears to be encoded by a different gene. The DNA clones provided herein may be used to isolate genomic clones encoding each type of subunit and to isolate any splice variants by screening libraries prepared from different neural tissues. Nucleic acid amplification techniques, which are well known in the art, can be used to locate DNA encoding splice variants of human NMDA receptor subunits. This is accomplished by employing oligonucleotides based on DNA sequences surrounding divergent sequence(s) as primers for amplifying human RNA or genomic DNA. Size and sequence determinations of the amplification products can reveal the existence of splice variants. Furthermore, isolation of human genomic DNA sequences by hybridization can yield DNA containing multiple exons, separated by introns, that correspond to different splice variants of transcripts encoding human NMDA receptor subunits.

It has been found that not all subunits (and variants thereof) are expressed in all neural tissues or in all portions of the brain. Thus, in order to isolate cDNA encoding a particular subunit or splice variants thereof, it is preferable to screen libraries prepared from different neuronal or neural tissues. Preferred tissues to use as sources of nucleic acids for preparing libraries to obtain DNA encoding each subunit include: hippocampus to isolate human NMDAR1-encoding DNAs; hippocampus, cerebellum and fetal brain to isolate NMDAR2-encoding DNAs; and the like.

Once DNA encoding a subunit has been isolated, ribonuclease (RNase) protection assays can be employed to determine which tissues express mRNA encoding a particular NMDAR subunit subtype or variant. These assays provide a sensitive means for detecting and quantitating an RNA species in a complex mixture of total cellular RNA. The subunit DNA is labeled and hybridized with cellular RNA. If complementary mRNA is present in the cellular RNA, a DNA-RNA hybrid results. The RNA sample is then treated with RNase, which degrades single-stranded RNA. Any RNA-DNA hybrids are protected from RNase degradation and can be visualed by gel electrophorsis and autoradiography. In situ hybridization techniques can also be used to determine which tissues express mRNA encoding a particular NMDAR subunit. The labeled subunit DNAs are hybridized to different brain region slices to visualize subunit mRNA expression.

The distribution of expression of some human NMDA receptor subunits may differ from the distribution of such receptors in rat. For example, RNA encoding the rat NMDAR2C subunit is abundant in rat cerebellum, but is not abundant in rat hippocampus [see, e.g., Monyer et al., Science 256:1217–1221 (1992)]. Numerous human NMDAR2C clones were ultimately obtained, however, from a human hippocampus library. Thus, the distribution of some NMDA receptor subunits in humans and rats appears to be different.

The above-described nucleotide sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

An expression vector includes vectors capable of expressing DNAs that are operatively linked with regulatory sequences, such as promoter regions, that are capable of effecting expression of such DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome. Presently preferred plasmids for expression of invention NMDA receptor subunits in eukaryotic host cells, particularly mammalian cells, include cytomegalovirus (CMV) promoter-containing vectors such as pCMV-T7-2 or pCMV-T7-3 (see FIG. 6), pMMTVT7(+) or pMMTVT7(–) (modified versions of pMAMneo (Clontech, Palo Alto, Calif.), prepared as described herein), pcDNA1, and the like.

As used herein, a promoter region refers to a segment of DNA that controls transcription of DNA to which it is operatively linked. The promoter region includes specific sequences that are sufficient for RNA polymerase recognition, binding and transcription initiation. This portion of the promoter region is referred to as the promoter. In addition, the promoter region includes sequences that modulate this recognition, binding and transcription initiation activity of RNA polymerase. These sequences may be cis acting or may be responsive to trans acting factors. Promoters, depending upon the nature of the regulation, may be constitutive or regulated. Exemplary promoters contemplated for use in the practice of the present invention include the SV40 early promoter, the cytomegalovirus (CMV) promoter, the mouse mammary tumor virus (MMTV) steroid-inducible promoter, Moloney murine leukemia virus (MMLV) promoter, and the like.

As used herein, the term "operatively linked" refers to the functional relationship of DNA with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes and binds to the promoter, and transcribes the DNA. In order to optimize expression and/or in vitro transcription, it may be necessary to remove, add or alter 5' and/or 3' untranslated portions of the clones to eliminate extra, potential inappropriate alternative translation initiation (i.e., start) codons or other sequences that may interfere with or reduce expression, either at the level of transcription or translation. Alternatively, consensus ribosome binding sites (see, for example, Kozak (1991) J. Biol. Chem. 266:19867–19870) can be inserted immediately 5' of the start codon and may enhance expression. Likewise, alternative codons, encoding the same amino acid, can be substituted for coding sequences of the NMDAR subunits in order to enhance transcription (e.g., the codon preference of the host cells can be adopted, the presence of G-C rich domains can be reduced, and the like). Furthermore, for potentially enhanced expression of NMDA receptor subunits in amphibian oocytes, the subunit coding sequence can optionally be incorporated into an expression construct wherein the 5'- and 3'-ends of the coding sequence are contiguous with Xenopus β-globin gene 5' and 3' untranslated sequences, respectively. For example, NMDA receptor subunit coding sequences can be incorporated into vector pSP64T (see Krieg and Melton (1984) in Nucleic Acids Research 12:7057–7070), a modified form of pSP64 (available from Promega, Madison, Wis.). The coding sequence is inserted between the 5' end of the β-globin gene and the 3' untranslated sequences located downstream of the SP6 promoter. In vitro transcripts can then be generated from teh resulting vector. The desirability of (or need for) such modification may be empirically determined.

As used herein, expression refers to the process by which polynucleic acids are transcribed into mRNA and translated into peptides, polypeptides, or proteins. If the polynucleic acid is derived from genomic DNA, expression may, if an appropriate eukaryotic host cell or organism is selected, include splicing of the mRNA.

Particularly preferred vectors for transfection of mammalian cells are the pSV2dhfr expression vectors, which contain the SV40 early promoter, mouse dhfr gene, SV40 polyadenylation and splice sites and sequences necessary for maintaining the vector in bacteria, cytomegalovirus (CMV) promoter-based vectors such as pCMV-T7-2 and pCMV-T7-3 (described herein) or pCDNA1 (Invitrogen, San Diego, Calif.), and MMTV promoter-based vectors such as pMMTVT7(+) or pMMTVT7(−), described herein.

Full-length DNAs encoding human NMDA receptor subunits have been inserted into vectors pcDNA1, pMMTVT7 (+), pCMV-T7-2 and pCMV-T7-3. pCMV-T7-2 is a pUC19-based mammalian cell expression vector containing the CMV promoter/enhancer, SV40 splice/donor sites located immediately downstream of the promoter, a T7 bacteriophage RNA polymerase promoter positioned downstream of the splice sites, followed by an SV40 polyadenylation signal and a polylinker between the T7 promoter and the polyadenylation signal. Placement of NMDA receptor subunit DNA between the CMV promoter and SV40 polyadenylation signal should provide for constitutive expression of the foreign DNA in a mammalian host cell transfected with the construct. Plasmid pCMV-T7-3 is identical to pCMV-T7-2 except that the order of restriction enzyme sites in the polylinker is reversed.

Vectors pMMTVT7(+) and pMMTVT7(−) were prepared by modifying vector pMAMneo (Clontech, Palo Alto, Calif.). pMAMneo is a mammalian expression vector that contains the Rous Sarcoma Virus (RSV) long terminal repeat (LTR) enhancer, linked to the dexamethasone-inducible mouse mammary tumor virus (MMTV)-LTR promoter, followed by SV40 splicing and polyadenylation sites. pMAMneo also contains the E. coli neo gene for selection of transformants, as well as the β-lactamase gene (encoding a protein which imparts ampicillin-resistance) for propagation in E. coli.

Vector pMMTVT7(+) can be generated by modification of pMAMneo to remove the neo gene and insert the multiple cloning site and T7 and T3 promoters from pBluescript (Stratagene, La Jolla, Calif.). Thus, pMMTVT7(+) contains the RSV-LTR enhancer linked to the MMTV-LTR promoter, a T7 bacteriophage RNA polymerase promoter positioned downstream of the MMTV-LTR promoter, a polylinker positioned downstream of the T7 promoter, a T3 bacteriophage RNA polymerase promoter positioned downstream of the T7 promoter, and SV40 splicing and polyadenylation sites positioned downstream of the T3 promoter. The β-lactamase gene (encoding a protein which imparts ampicillin-resistance) from pMAMneo is retained in pMMTVT7(+), although it is incorporated in the reverse orientation relative to the orientation in pMAMneo.

Vector pMMTVT7(−) is identical to pMMTVT7(+) except that the positions of the T7 and T3 promoters are switched, i.e., the T3 promoter in pMMTVT7(−) is located where the T7 promoter is located in pMMTVT7(+), and the T7 promoter in pMMTVT7(−) is located where the T3 promoter is located in pMMTVT7(+). Therefore, vectors pMMTVT7(+) and pMMTVT7(−) contain all of the regulatory elements required for expression of heterologous DNA in a mammalian host cell, wherein the heterologous DNA has been incorporated into the vectors at the polylinker. In addition, because the T7 and T3 promoters are located on either side of the polylinker, these plasmids can be used for synthesis of in vitro transcripts of heterologous DNA that has been subcloned into the vectors at the polylinker.

For inducible expression of human NMDA receptor subunit-encoding DNA in a mammalian cell, the DNA can be inserted into a plasmid such as pMMTVT7(+) or pMMTVT7(−). These plasmids contain the mouse mammary tumor virus (MMTV) promoter for steroid-inducible expression of operatively associated foreign DNA. If the host cell does not express endogenous glucocorticoid receptors required for uptake of glucocorticoids (i.e., inducers of the MMTV promoter) into the cell, it is necessary to additionally transfect the cell with DNA encoding the glucocorticoid receptor (ATCC accession no. 67200). For synthesis of in vitro transcripts, full-length human DNA clones encoding human NMDAR1, NMDAR2A, NMDAR2B, NMDAR2C and NMDAR2D can also be subcloned into pIBI24 (International Biotechnologies, Inc., New Haven, Conn.), pCMV-T7-2, pCMV-T7-3, pMMTVT7(+), pMMTVT7(−), pBluescript (Stratagene, La Jolla, Calif.) or pGEM7Z (Promega, Madison, Wis.).

In accordance with another embodiment of the present invention, there are provided cells containing the above-described polynucleic acids (i.e., DNA or mRNA). Such host cells as bacterial, yeast and mammalian cells can be used for replicating DNA and producing NMDA receptor subunit(s). Methods for assessing receptor expression and function are described in PCT Application Nos. PCT/US91/ 05625 and PCT/US92/11090, and in co-pending U.S. application Ser. Nos. 07/563,751 and 07/812,254. The subject matter of these documents is hereby incorporated by reference herein in their entirety.

Incorporation of cloned DNA into a suitable expression vector, transfection of eukaryotic cells with a plasmid vector or a combination of plasmid vectors, each encoding one or more distinct genes or with linear DNA, and selection of transfected cells are well known in the art (see, e.g., Sambrook et al. (1989) *Molecular Cloning: A Laboratory Manual*, Second Edition, Cold Spring Harbor Laboratory Press). Heterologous DNA may be introduced into host cells by any method known to those of skill in the art, such as transfection with a vector encoding the heterologous DNA by $CaPO_4$ precipitation (see, e.g., Wigler et al. (1979) Proc. Natl. Acad. Sci. 76:1373–1376) or lipofectamine (GIBCO BRL #18324-012). Recombinant cells can then be cultured under conditions whereby the subunit(s) encoded by the DNA is (are) expressed. Preferred cells include mammalian cells (e.g., HEK293, CHO, BHKBI and Ltk⁻ cells, mouse monocyte macrophage P388D1 and J774A-1 cells (available from ATCC, Rockville, Md.), and the like), yeast cells (e.g., methylotrophic yeast cells, such as *Pichia pastoris*), bacterial cells (e.g., *Escherichia coli*), and the like.

While the DNA provided herein may be expressed in any eukaryotic cell, including yeast cells (such as for example, *P. pastoris* (see U.S. Pat. Nos. 4,882,279, 4,837,148, 4,929, 555 and 4,855,231), *Saccharomyces cerevisiae, Candida tropicalis, Hansenula polymorpha*, and the like), mammalian expression systems, including commercially available systems and other such systems known to those of skill in the art, for expression of DNA encoding the human NMDA receptor subunits provided herein are presently preferred. Xenopus oocytes are preferred for expression of in vitro RNA transcripts of the DNA.

In preferred embodiments, human NMDAR subunit-encoding DNA is ligated into a vector, and introduced into suitable host cells to produce transformed cell lines that express a specific human NMDA receptor subtype, or specific combinations of subunits. The resulting cell lines can then be produced in quantity for reproducible quantitative analysis of the effects of known or potential drugs on receptor function. In other embodiments, mRNA may be produced by in vitro transcription of DNA encoding each subunit. This mRNA, either from a single subunit clone or from a combination of clones, can then be injected into Xenopus oocytes where the mRNA directs the synthesis of the human receptor subunits, which then form functional receptors. Alternatively, the subunit-encoding DNA can be directly injected into oocytes for expression of functional receptors. The transfected mammalian cells or injected oocytes may then be used in the methods of drug screening provided herein.

Eukaryotic cells in which DNA or RNA may be introduced include any cells that are transfectable by such DNA or RNA or into which such DNA or RNA may be injected. Preferred cells are those that can be transiently or stably transfected and also express the DNA and RNA. Presently most preferred cells are those that can form recombinant or heterologous human NMDA receptors comprising one or more subunits encoded by the heterologous DNA. Such cells may be identified empirically or selected from among those known to be readily transfected or injected.

Exemplary cells for introducing DNA include cells of mammalian origin (e.g., COS cells, mouse L cells, Chinese hamster ovary (CHO) cells, human embryonic kidney (HEK) cells (particularly HEK293 cells that can be frozen in liquid nitrogen and then thawed and regrown; for example, those described in U.S. Pat. No. 5,024,939 to Gorman (see, also, Stillman et al. (1985) Mol. Cell. Biol. 5:2051–2060)), African green monkey cells and other such cells known to those of skill in the art), amphibian cells (e.g., *Xenopus laevis* oöcytes), yeast cells (e.g., *Saccharomyces cerevisiae, Pichia pastoris*), and the like. Exemplary cells for expressing injected RNA transcripts include *Xenopus laevis* oöcytes. Cells that are preferred for transfection of DNA are known to those of skill in the art or may be empirically identified, and include HEK293 (which are available from ATCC under accession #CRL 1573); Ltk⁻ cells (which are available from ATCC under accession #CCL1.3); COS-7 cells (which are available from ATCC under accession #CRL 1651); and DG44 cells (dhfr⁻ CHO cells; see, e.g., Urlaub et al. (1986) Cell. Molec. Genet. 12: 555). Presently preferred cells include Ltk⁻ cells and DG44 cells.

DNA may be stably incorporated into cells or may be transiently expressed using methods known in the art. Stably transfected mammalian cells may be prepared by transfecting cells with an expression vector having a selectable marker gene (such as, for example, the gene for thymidine kinase, dihydrofolate reductase, neomycin resistance, and the like), and growing the transfected cells under conditions selective for cells expressing the marker gene. To prepare transient transfectants, mammalian cells are transfected with a reporter gene (such as the *E. coli* β-galactosidase gene) to monitor transfection efficiency. Selectable marker genes are not included in the transient transfections because the transfectants are typically not grown under selective conditions, and are usually analyzed within a few days after transfection.

To produce such stably or transiently transfected cells, the cells should be transfected with a sufficient concentration of subunit-encoding nucleic acids to form human NMDA receptors that contain the human subunits encoded by heterologous DNA. The precise amounts and ratios of DNA encoding the subunits may be empirically determined and optimized for a particular combination of subunits, cells and assay conditions. Recombinant cells that express NMDA receptors containing subunits encoded only by the heterologous DNA or RNA are especially preferred.

Heterologous DNA may be maintained in the cell as an episomal element or may be integrated into chromosomal DNA of the cell. The resulting recombinant cells may then be cultured or subcultured (or passaged, in the case of mammalian cells) from such a culture or a subculture thereof. Methods for transfection, injection and culturing recombinant cells are known to the skilled artisan. Similarly, the human NMDA receptor subunits may be purified using protein purification methods known to those of skill in the art. For example, antibodies or other ligands that specifically bind to one or more of the subunits may be used for affinity purification and immunoprecipitation of the subunit or human NMDA receptors containing the subunits.

As used herein, heterologous or foreign DNA and RNA are used interchangeably and refer to DNA or RNA that does not occur naturally as part of the genome of the cell in which it is present or to DNA or RNA which is found in a location or locations in the genome that differ from that in which it occurs in nature. Typically, heterologous or foreign DNA and RNA refers to DNA or RNA that is not endogenous to the host cell and has been artificially introduced into the cell. Examples of heterologous DNA include DNA that encodes a human NMDA receptor subunit, DNA that encodes RNA or proteins that mediate or alter expression of endogenous DNA by affecting transcription, translation, or other regulatable biochemical processes, and the like. The cell that expresses heterologous DNA may contain DNA encoding the same or different expression products. Heterologous DNA need not be expressed and may be integrated into the host cell genome or maintained episomally.

Recombinant receptors on recombinant eukaryotic cell surfaces may contain one or more subunits encoded by the DNA or mRNA encoding human NMDA receptor subunits, or may contain a mixture of subunits encoded by the host cell and subunits encoded by heterologous DNA or mRNA. Recombinant receptors may be homomeric or may be a heteromeric combination of multiple subunits. Mixtures of DNA or mRNA encoding receptors from various species, such as rats and humans, may also be introduced into the cells. Thus, a cell can be prepared that expresses recombinant receptors containing only NMDAR1 subunits, or a combination of any one or more NMDAR1 and any one or more NMDAR2 subunits provided herein. For example, NMDAR1 subunits of the present invention can be co-expressed with NMDAR2A, NMDAR2B, NMDAR2C and/or NMDAR2D receptor subunits. Specific examples of heteromeric combinations of recombinant human NMDAR subunits that have been expressed in Xenopus oocytes include NMDAR1+NMDAR2A, NMDAR1+NMDAR2B, and NMDAR1+NMDAR2A+NMDAR2C (see Example 9).

The DNA, mRNA, vectors, receptor subunits, receptor subunit combinations and cells provided herein permit production of selected NMDA receptor subunits and specific combinations thereof, as well as antibodies to said receptor subunits. This provides a means to prepare synthetic or recombinant receptors and receptor subunits that are substantially free of contamination from many other receptor proteins whose presence can interfere with analysis of a single NMDA receptor subtype. The availability of desired receptor subtypes makes it possible to observe the effect of a drug substance on a particular receptor subtype or combination of NMDA receptor subunits, and to thereby perform initial in vitro screening of the drug substance in a test system that is specific for humans and specific for a human NMDA receptor subtype or combination of NMDA receptor subunits. The availability of specific antibodies makes it possible to identify the subunit combinations expressed in vivo. Such specific combinations can then be employed as preferred targets in drug screening.

The ability to screen drug substances in vitro to determine the effect of the drug on specific receptor compositions should permit the development and screening of receptor subtype-specific or disease-specific drugs. Also, testing of single receptor subunits or specific combinations of various types of receptor subunits with a variety of potential agonists or antagonists provides additional information with respect to the function and activity of the individual subunits and should lead to the identification and design of compounds that are capable of very specific interaction with one or more types of receptor subunits or receptor subtypes. The resulting drugs should exhibit fewer unwanted side effects than drugs identified by screening with cells that express a variety of receptor subtypes.

Further in relation to drug development and therapeutic treatment of various disease states, the availability of DNAs encoding human NMDA receptor subunits enables identification of any alterations in such genes (e.g., mutations) which may correlate with the occurrence of certain disease states. In addition, the creation of animal models of such disease states becomes possible, by specifically introducing such mutations into synthetic DNA sequences which can then be introduced into laboratory animals or in vitro assay systems to determine the effects thereof.

In another aspect, the invention comprises functional peptide fragments, and functional combinations thereof, encoded by the DNAs of the invention. Such functional peptide fragments can be produced by those skilled in the art, without undue experimentation, by eliminating some or all of the amino acids in the sequence not essential for the peptide to function as a glutamate receptor. A determination of the amino acids that are essential for glutamate receptor function is made, for example, by systematic digestion of the DNAs encoding the peptides and/or by the introduction of deletions into the DNAs. The modified (e.g., deleted or digested) DNAs are expressed, for example, by transcribing the DNA and then introducing the resulting mRNA into Xenopus oocytes, where translation of the mRNAs will occur. Functional analysis of the proteins thus expressed in the oocytes is accomplished by exposing the oocytes to ligands known to bind to and functionally activate glutamate receptors, and then monitoring the oocytes to see if the expressed fragments form ion channel(s). If ion channel(s) are detected, the fragments are functional as glutamate receptors.

The above-described method can be carried out in the presence of NMDAR1-like receptor subunits alone, or in the presence of combinations of NMDAR1-like and NMDAR2-like receptor subunits. Thus, for example, when the protein being tested is an NMDAR2-like receptor subunit, the additional subunit is preferably an NMDAR1-like subunit.

In accordance with still another embodiment of the present invention, there is provided a method for identifying compounds which bind to human N-methyl-D-aspartate (NMDA) receptor subunit(s), said method comprising employing receptor proteins of the invention in a competitive binding assay. Such an assay can accomodate the rapid screening of a large number of compounds to determine which compounds, if any, are capable of binding to NMDA receptors. Subsequently, more detailed assays can be carried out with those compounds found to bind, to further determine whether such compounds act as modulators, agonists or antagonists of invention receptors.

Another application of the binding assay of the invention is the assay of test samples (e.g., biological fluids) for the presence or absence of receptors of the present invention. Thus, for example, serum from a patient displaying symptoms related to glutamatergic pathway dysfunction can be assayed to determine if the observed symptoms are perhaps caused by over- or under-production of such receptor(s).

The binding assays contemplated by the present invention can be carried out in a variety of ways, as can readily be identified by those of skill in the art. For example, competitive binding assays can be employed, such as radioreceptor assays, and the like.

In accordance with a further embodiment of the present invention, there is provided a bioassay for identifying compounds which modulate the activity of human NMDA receptors of the invention, said bioassay comprising:

(a) exposing cells containing DNA encoding human NMDA receptor subunit(s), wherein said cells express functional NMDA receptors, to at least one compound whose ability to modulate the ion channel activity of said receptors is sought to be determined; and thereafter (b) monitoring said cells for changes in ion channel activity.

The above-described bioassay enables the identification of agonists and antagonists for human NMDA receptors. According to this method, recombinant NMDA receptors are contacted with an "unknown" or test substance (in the further presence of a known NMDA agonist, when antagonist activity is being tested), the ion channel activity of the known glutamate receptor is monitored subsequent to the contact with the "unknown" or test substance, and those substances which increase or decrease the ion channel response of the known glutamate receptor(s) are identified as functional ligands (i.e., modulators, agonists or antagonists) for human NMDA receptors.

In accordance with a particular embodiment of the present invention, recombinant human NMDA receptor-expressing mammalian cells or oocytes can be contacted with a test compound, and the modulating effect(s) thereof can then be evaluated by comparing the NMDA receptor-mediated response in the presence and absence of test compound, or by comparing the response of test cells, or control cells (i.e., cells that do not express NMDA receptors), to the presence of the compound.

As used herein, a compound or signal that "modulates the activity of an NMDA receptor" refers to a compound or signal that alters the activity of NMDA receptors so that activity of the NMDA receptor is different in the presence of the compound or signal than in the absence of the compound or signal. In particular, such compounds or signals include agonists and antagonists. The term agonist refers to a substance or signal, such as NMDA, that activates receptor function; and the term antagonist refers to a substance that interferes with receptor function. Typically, the effect of an antagonist is observed as a blocking of activation by an agonist. Antagonists include competitive and non-competitive antagonists. A competitive antagonist (or competitive blocker) interacts with or near the site specific for the agonist (e.g., ligand or neurotransmitter). A non-competitive antagonist or blocker inactivates the functioning of the receptor by interacting with a site other than the site that interacts with the agonist.

As understood by those of skill in the art, assay methods for identifying compounds that modulate human NMDA receptor activity (e.g., agonists and antagonists) generally require comparison to a control. One type of a "control" cell or "control" culture is a cell or culture that is treated substantially the same as the cell or culture exposed to the test compound, except the control culture is not exposed to test compound. For example, in methods that use voltage clamp electrophysiological procedures, the same cell can be tested in the presence and absence of test compound, by merely changing the external solution bathing the cell. Another type of "control" cell or "control" culture may be a cell or a culture of cells which is identical to the transfected cells, except the cells employed for the control culture do not express functional human NMDA receptor subunits. In this situation, the response of test cell to test compound is compared to the response (or lack of response) of receptor-negative (control) cell to test compound, when cells or cultures of each type of cell are exposed to substantially the same reaction conditions in the presence of compound being assayed.

In accordance with yet another embodiment of the present invention, the ion channel activity of human N-methyl-D-aspartate (NMDA) receptors can be modulated by contacting such receptors with an effective amount of at least one compound identified by the above-described bioassay.

In accordance with yet another embodiment of the present invention, there are provided antibodies generated against the above-described receptor proteins. Such antibodies can be employed for studying receptor tissue localization, subunit composition, structure of functional domains, as well as in diagnostic applications, therapeutic applications, and the like. Preferably, for therapeutic applications, the antibodies employed will be monoclonal antibodies.

The above-described antibodies can be prepared employing standard techniques, as are well known to those of skill in the art, using the invention receptor proteins or portions thereof as antigens for antibody production. Both anti-peptide and anti-fusion protein antibodies can be used [see, for example, Bahouth et al. (1991) *Trends Pharmacol Sci.* vol. 12:338–343; *Current Protocols in Molecular Biology* (Ausubel et al., eds.) John Wiley and Sons, New York (1989)]. Factors to consider in selecting portions of the NMDAR subunits for use as immunogen (as either a synthetic peptide or a recombinantly produced bacterial fusion protein) include antigenicity, accessibility (i.e., extracellular and cytoplasmic domains), uniqueness to the particular subunit, etc.

The availability of subunit-specific antibodies makes possible the application of the technique of immunohistochemistry to monitor the distribution and expression density of various subunits (e.g., in normal vs diseased brain tissue). Such antibodies could also be employed for diagnostic and therapeutic applications.

In accordance with still another embodiment of the present invention, there are provided methods for modulating the ion channel activity of receptor(s) of the invention by contacting said receptor(s) with an effective amount of the above-described antibodies.

The antibodies of the invention can be administered to a subject employing standard methods, such as, for example, by intraperitoneal, intramuscular, intravenous, or subcutaneous injection, implant or transdermal modes of administration, and the like. One of skill in the art can readily determine dose forms, treatment regiments, etc, depending on the mode of administration employed.

The invention will now be described in greater detail by reference to the following non-limiting examples.

EXAMPLE 1

Isolation of DNA Encoding Human NMDA Receptor NMDAR1 Subunits

A. cDNA Library Screening

RNA isolated from human hippocampus tissue was used as a template for the synthesis of oligo dT-primed and randomly primed, single-stranded cDNA according to standard procedures [see, for example, Maniatis et al. (1982) *Molecular Cloning: A Laboratory Manual*, Cold Spring Harbor Laboratory Press, Cold Spring Harbor, N.Y.]. The single-stranded cDNA was converted to double-stranded cDNA, and EcoRI/SnaBI/XhoI adaptors were added to the ends thereof. The cDNAs were separated by size using agarose gel electrophoresis, and those that were >2.0 kb were ligated into EcoRI-digested λgt10 bacteriophage vectors. The resulting cDNA library was amplified by replication of each clone through limited infection of a bacterial host, and stored at −70° C.

The amplified hippocampus oligo dT-primed cDNA library was later retrieved from storage and $1 \times 10^6$ recombinants were screened for hybridization to oligonucleotides corresponding to nucleotides 96–128 (SE7) and nucleotides 2576–2609 (SE8) of the rat NMDAR1A receptor cDNA (see Moriyoshi et al. (1991) Nature 354:31). Hybridization was performed at 42° C. in 6×SSPE, 5×Denhart's solution, 10% formamide, 0.2% SDS and 200 μg/ml herring sperm DNA. Washes were performed in 1×SSPE and 0.2% SDS at 50° C. Hybridizing clones (e.g. NMDA1–3) were identified. These clones hybridized to SE8 but not to SE7.

A randomly primed primary human hippocampus cDNA library (~2×10⁵ recombinants prepared by selecting only cDNAS >2.0 kb for inclusion in the library) was screened under the same conditions for hybridization to oligonucleotide SE8 and an oligonucleotide corresponding to nucleotides 129–141 of the rat NMDAR1A receptor cDNA (SE11). Five hybridizing clones, which hybridized to SE8 and not to SE11, were identified: NMDA5–7 and NMDA10–11.

B. Characterization of Clones

The clones were plaque purified and characterized by restriction enzyme mapping and DNA sequence analysis of the inserts. One of the clones, NMDA11 (see description of Sequence ID No. 13 in summary of sequences for a description of a portion of NMDA11), is a full-length cDNA (i.e., it contains translation initiation and termination codons) encoding a complete NMDAR1 subunit. The remaining clones are partial cDNAs. Clones NMDA2, NMDA3 (see Sequence ID No. 17), NMDA5, NMDA6, NMDA7(see Sequence ID No 15), and NMDA10 (which encodes a 3083 nucleotide sequence comprising nucleotides 320-3402 of Sequence ID No. 1) contain a translation termination codon but lack nucleotides at the 5' end of the coding sequence.

Characterization of the clones revealed that the isolated cDNAs correspond to different alternatively spliced forms of the human NMDAR1 subunit transcript. The four types of alternate splicing represented by the clones are depicted schematically in FIG. 1. Clone NMDA10 (which lacks 5' untranslated sequences as well as 60 nucleotides of the 5' end of the coding sequence) is used as a reference to which the other variants are compared. Clone NMDA11 lacks 363 nucleotides (in the 3' portion of the clone) that are present in NMDA10. This 363-nucleotide deletion does not disrupt the reading frame of the transcript; however, it results in a different termination codon. The last 69 nucleotides of the coding sequence of NMDA11 correspond to 3' untranslated sequence of clone NMDA10 (i.e., nucleotides 3325–3393 of Sequence ID No. 1). Clone NMDA7 lacks the same 363-nucleotide sequence that is deleted from NMDA11; however, NMDA7 further lacks 204 nucleotides at the 5' end that are present in NMDA10 and NMDA11. This 204-nucleotide deletion also does not disrupt the reading frame of the transcript. Additionally, NMDA7 contains a 63-nucleotide in-frame insertion at the 5' end relative to NMDA10 and NMDA11. The last 69 base pairs of the coding sequence of NMDA7 correspond to 3' untranslated sequence of NMDA10 i.e., nucleotides 3325–3393 of Sequence ID No. 1). Clone NMDA3 lacks 1087 base pairs at the 3' end that are present in NMDA10. This 1087-base pair deletion does not disrupt the reading frame of the transcript; however it results in a different termination codon. The last 231 base pairs of the coding sequence of NMDA3 correspond to 3' untranslated sequence of clone NMDA10 (i.e., nucleotides 4049–4279 in Sequence ID No. 1).

EXAMPLE 2

Preparation of Full-length NMDAR1 Subunit cDNA Constructs

Portions of clones NMDA10, NMDA11, NMDA7 and NMDA3 were ligated together to construct full-length cDNAs encoding variants of the NMDA receptor NMDAR1 subunit. The full-length NMDAR1 subunit cDNAs were incorporated into vector pcDNA1 (Invitrogen, San Diego, Calif.) for use in expressing the receptor subunits in mammalian host cells and for use in generating in vitro transcripts of the DNAs to be expressed in Xenopus oocytes.

Vector pcDNA1 is a pUC19-based plasmid that contains the following elements in the 5'-to-3' order: the cytomegalovirus (CMV) immediate early gene promoter/enhancer, the bacteriophage T7 RNA polymerase promoter, a polylinker, the bacteriophage SP6 RNA polymerase promoter, SV40 RNA processing (i.e., splice donor/acceptor) signals, SV40 polyadenylation signal, and the ColE1 origin and supF suppressor tRNA to permit maintenance of the vector in *Escherichia coli* strains with the P3 episome. This vector thus contains all the regulatory elements required for expression of heterologous DNA in a mammalian host cell, wherein the heterologous DNA has been incorporated into the vector at the polylinker. In addition, because the T7 and SP6 promoters are located on either side of the polylinker, this plasmid can be used for synthesis of in vitro transcripts of heterologous DNA that has been sublconed into the vector at the polylinker.

A. NMDAR1A

Figure 2:
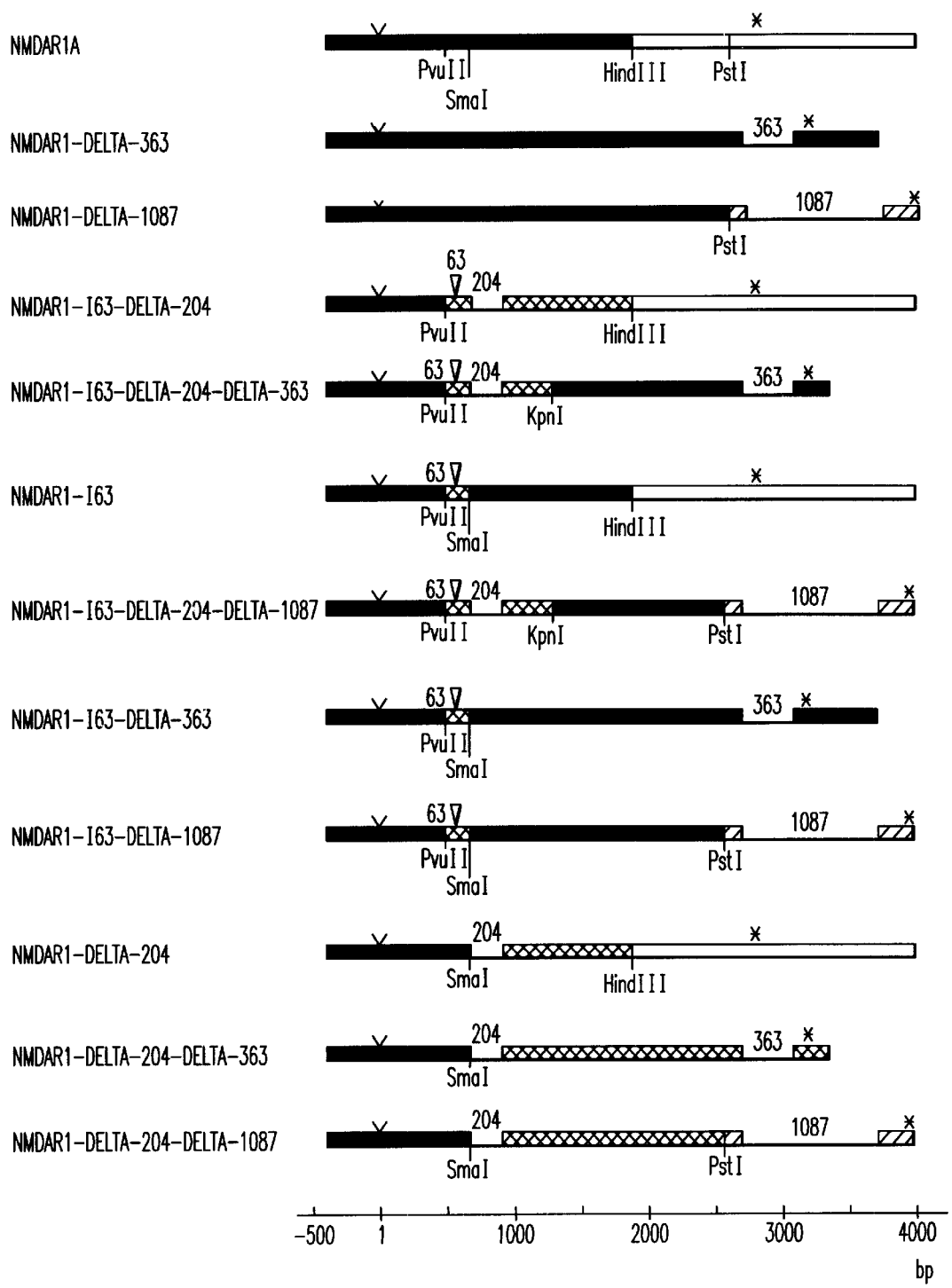
FIG. 2 is a schematic representation of cDNAs encoding full-length human NMDAR1 subunit subtypes of the invention, with partial restriction maps of each DNA. The full-length cDNAs are constructed by ligation of appropriate portions of the clones shown in FIG. 1. Regions of each full-length cDNA composed of nucleotide sequences corresponding to a particular clone are distinguished as solid, striped, cross-hatched or open boxes.

Full-length construct NMDAR1A was prepared by ligation of a 5' portion of NMDA11 (beginning 5' of the translation initiation codon and extending to the HindIII site in the middle of the clone) and a 3' portion of NMDA10 (beginning at the HindIII site in the middle of the clone and extending 3' of the translation termination codon) as depicted in FIG. 2. The two DNA fragments were joined in mammalian expression vector pcDNA1.

Initially, the strategy for generating the NMDAR1 construct involved a first step of separately subcloning the entire 4.0 kb EcoRI insert fragment of NMDA10 and the entire 4.0 kb SnaBI insert fragment of NMDA11 into pcDNA1; however, two attempts employing this cloning strategy were unsuccessful. It appeared that there may have been selection against *E. coli* hosts retaining the complete insert fragments since the surviving recombinant *E. coli* that were analyzed contained incomplete insert cDNAs from which nucleotides had been deleted. Therefore, it was necessary to prepare the full-length NMDAR1A construct in several steps by subcloning and combining various fragments of NMDA10 and NMDA11 in pcDNA1 as follows (see FIG. 3 for locations of restriction enzyme sites).

Clone NMDA10 was digested with BglII and EcoRI and the ~3.3 kb fragment containing nucleotides 1020–4298 of Sequence ID No. 1 was isolated and subcloned into BamHI/EcoRI-digested pcDNA1. The resulting plasmid was digested with HindIII and NheI and the fragment containing nucleotides 2137–4298 of Sequence ID No. 1 plus a portion of pcDNA1 was isolated.

Clone NMDA11 was digested with EcoRI and HindIII and the ~2.1 kb fragment containing nucleotides 1–2136 of Sequence ID No. 1 was isolated and subcloned into EcoRI/HindIII-digested modified pcDNA1 (modified by deletion of the HindIII site located 5' of the EcoRI site in the polylinker and addition of a HindIII site into the polylinker at a position 3' of the EcoRI site). The resulting plasmid was digested with NheI and HindIII and the fragment containing nucleotides 1–2136 of Sequence ID No. 1 plus a portion of modified pcDNA1 was isolated. This NheI/HindIII fragment was then ligated to the HindIII/NheI fragment containing nucleotides 2137–4298 of Sequence ID No. 1 to generate the full-length construct NMDAR1A (see FIG. 2). The ligation mix was used to transform *E. coli* strain MC1061/P3. Because the NheI site in pcDNA1 occurs within the supF selection gene, only *E. coli* containing the correctly ligated, complete NMDAR1A plasmid (which has the complete, functional selection gene) were able to survive the selection process. This fragment subcloning strategy enabled selection of the desired correct NMDAR1A-containing *E. coli* host cells, even though the total number of such recombinant host cells was small.

In summary, construct NMDAR1A contains 261 base pairs of 5' untranslated sequence from NMDAR11 (nucleotides 1–261 of Sequence ID No. 1) and a complete coding sequence (nucleotides 262–3078 of Sequence ID No. 1) for the NMDAR1A variant of the NMDAR1 subunit as well as 1220 base pairs of 3' untranslated sequence (nucleotides 3079–4298 of Sequence ID No. 1). The NMDAR1A-encoding sequence is operatively linked to the regulatory elements in pcDNA1 for expression in mammalian cells.

B. NMDAR1-Δ363

Full-length construct NMDAR1-Δ363 was prepared by ligation of a 5' portion of NMDA11 (beginning 5' of the translation initiation codon and extending to the HindIII site in the middle of the clone, i.e., nucleotides 1–2136 in Sequence ID No. 1) and a 3' portion of NMDA11 (beginning at the HindIII site in the middle of the clone and extending 3' of the translation termination codon, i.e., nucleotides 2137–2961 and 3325–4298 of Sequence ID No. 1). As described above, due to the difficulty in directly subcloning the entire 4.0 kb SnaBI NMDA11 insert into pcDNA1, it was necessary to generate the construct by ligating two fragments of the NMDA11 insert into pcDNA1 as follows (see FIG. 3 for locations of restriction enzyme sites).

To obtain the 5' NMDA11 fragment, clone NMDA11 was digested with EcoRI and HindIII and the ~2.2 kb fragment containing nucleotides 1–2136 of Sequence ID No. 1 was isolated and subcloned into EcoRI/HindIII-digested modified pcDNA1 (modified as described above). The resulting plasmid was digested with NheI and HindIII and the fragment containing nucleotides 1–2136 of Sequence ID No. 1 plus a portion of modified pcDNA1 was isolated.

To obtain the 3' NMDA11 fragment, clone NMDA11 was digested with BglII and EcoRI and the 3.0 kb fragment containing nucleotides 1020–2961 and 3325–4298 of Sequence ID No. 1 was isolated and subcloned into BamHI/EcoRI-digested pcDNA1. The resulting plasmid was digested with HindIII and NheI and the fragment containing nucleotides 2137–2961 and 3325–4298 of Sequence ID No. 1 plus a portion of pcDNA1 was isolated. This HindIII/NheI fragment was then ligated to the NheI/HindIII fragment containing nucleotides 1–2136 of Sequence ID No. 1 to generate NMDAR1-Δ363.

In summary, construct NMDAR1-Δ363 contains 261 base pairs of 5' untranslated sequence (nucleotides 1–261 of Sequence ID No. 1) and a complete coding sequence for the NMDAR1-Δ363 variant NMDAR1 subunit (nucleotides 262–2961 and 3325–3393 of Sequence ID No. 1) as well as 905 base pairs of 3' untranslated sequence (nucleotides 3394–4298 of Sequence ID No. 1). Thus, NMDAR1-Δ363 differs from NMDAR1 in that it lacks 363 nucleotides (nucleotides 2962–3324 of Sequence ID No. 1) that comprise the last 117 nucleotides of the coding sequence and the first 246 nucleotides of the 3' untranslated sequence of NMDAR1. The NMDAR1-Δ363 subunit variant-encoding sequence is operatively linked to the regulatory elements in pcDNA1 for expression in mammalian cells.

C. NMDAR1-Δ-1087

Full-length construct NMDAR1-Δ1087 was prepared by replacing the 3' end of the NMDAR1 variant-encoding insert of NMDAR1-Δ363 with a fragment from the 3' end of clone NMDA3 (see FIG. 2). Plasmid NMDAR1-Δ363 was partially digested with PstI and completely digested with XbaI. There is a PstI site ~112 nucleotides upstream of the location of the 363-nucleotide deletion in NMDAR1-Δ363 and an XbaI site in the polylinker located downstream of the 3' untranslated sequence of NMDAR1-Δ363 (see FIG. 3). Thus, PstI/XbaI digestion of NMDAR1-Δ363 results in removal of a fragment containing nucleotides 2850–2961 and 3325–4298 of Sequence ID No. 1 from the vector. The larger fragment was isolated from the digest.

The insert of clone NMDA3 was cloned into the EcoRI restriction site(s) of pGEM (Promega, Madison, Wis.); and the resulting plasmid was digested with PstI and XbaI. The smaller fragment containing nucleotides 2850–2961 and 4049–4298 of Sequence ID No. 1 was isolated and ligated to the larger fragment from the PstI/XbaI digest of NMDAR1-Δ363. The resulting construct was designated NMDAR1-Δ1087.

In summary, NMDAR1-Δ1087 contains 261 base pairs of 5' untranslated sequence (nucleotides 1–261 in Sequence ID No. 1), the complete coding sequence for the NMDAR1-Δ1087 variant NMDAR1 subunit (nucleotides 262–2961 and 4049–4279 of Sequence ID No. 1) and 19 base pairs of 3' untranslated sequence (nucleotides 4280–4298 of Sequence ID No. 1). Thus, NMDAR1-Δ1087 differs from NMDAR1 in that it lacks 1087 nucleotides (nucleotides 2962–4048 of Sequence ID No. 1) that comprise the last 117 nucleotides of the coding sequence and the first 970 nucleotides of the 3' untranslated sequence of NMDAR1. The NMDAR1-Δ1087 subunit variant-encoding sequence is operatively linked to the regulatory elements in pcDNA1 for expression in mammalian cells.

D. NMDAR1-I63-Δ204

Full-length construct NMDAR1-I63-Δ204 was prepared by replacing a 1399-nucleotide fragment of construct NMDAR1A (i.e, nucleotides 738–2136 of Sequence ID No. 1) with the PvuII-HindIII fragment of NMDA7 (i.e., nucleotides 738–831 of sequence ID No. 1, plus nucleotides 1–63 of Sequence ID No. 3 and nucleotides 832–984 and 1189–2136 of Sequence ID No. 1), as depicted in FIG. 2. Because there are multiple PvuII sites in the NMDAR1 construct, a several-step process was required for construction of NMDAR1-I63-Δ204 as follows (see FIG. 3 for the location of restriction enzyme sites).

The ~2.2-kb EcoRI-HindIII fragment isolated from construct NMDAR1A and containing nucleotides 1–2136 of Sequence ID No. 1 was ligated with modified pcDNA1 (modified as described in Example 2A) that had been digested with EcoRI and HindIII. The resulting plasmid was digested with AvrII and self-ligated to remove two PvuII sites from a portion of the plasmid contributed by pcDNA1. The plasmid was then partially digested with PvuII and completely digested with HindIII. The digest was ligated with a 1258-nucleotide PvuII-HindIII fragment isolated from clone NMDA7. The resulting plasmid, designated NMDAR1-I63-Δ204-5', was digested with BamHI and HindIII and the ~2-kb fragment containing nucleotides 1–831 of Sequence ID No. 1, plus nucleotides 1–63 of Sequence ID No. 3 and nucleotides 832–984 and 1189–2136 of Sequence ID No. 1 was isolated and ligated to BamHI/HindIII-digested NMDAR1 to generate NMDAR1-I63-Δ204.

NMDAR1-I63-Δ204 contains 261 base pairs of 5' untranslated sequence (nucleotides 1–261 in Sequence ID No. 1), the complete coding sequence for the NMDAR1-I63-Δ204 variant NMDAR1 subunit (nucleotides 262–831 of Sequence ID No. 1 plus nucleotides 1–63 of Sequence ID No. 3 and nucleotides 832–984 and 1189–3078 of Sequence ID No. 1) and 1220 base pairs of 3' untranslated sequence (nucleotides 3079–4298 of Sequence ID No. 1). Thus NMDAR1-I63-Δ204 differs from NMDAR1 in that it contains 63 nucleotides that are not present in NMDAR1

(nucleotides 1–63 of Sequence ID No. 3) located between nt 831 and 832 of Sequence ID No. 1. Further, NMDAR1-I63-Δ204 lacks 204 nucleotides that are present in NMDAR1 (nucleotides 985–1188 of Sequence ID No. 1). The NMDAR1-I63-Δ204 subunit variant-encoding sequence is operatively linked to the regulatory elements in pcDNA1 for expression in mammalian cells.

E. NMDAR1-I63

Full-length construct NMDAR1-I63 can be described as NMDAR1 in which a 173-bp fragment (nucleotides 738–910 of Sequence ID No. 1) is replaced with the 236-bp PvuII-SmaI fragment of NMDA7 (nucleotides 738–831 of Sequence ID No. 1, plus nucleotides 1–63 of Sequence ID No. 3 and nucleotides 832–910 of Sequence ID No. 1). Because there are multiple PvuII sites in the NMDAR1 construct, a several-step process was required for construction of NMDAR1-I63 as follows. Plasmid NMDAR1-I63-Δ204-5' was partially digested with SmaI and completely digested with HindIII. The larger vector fragment was ligated with the 1226-bp SmaI/HindIII fragment isolated from NMDA11 (nucleotides 911–2136 of Sequence ID No. 1). The resulting vector was digested with BamHI and HindIII and the ~2.2-kb fragment containing nucleotides 1–831 of Sequence ID No. 1, plus nucleotides 1–63 of Sequence ID No. 3 and nucleotides 832–2136 of Sequence ID No. 1 was isolated and ligated to BamHI/HindIII-digested NMDAR1 to generate NMDAR1–163.

NMDAR1-I63 contains 261 base pairs of 5' untranslated sequence (nucleotides 1–261 in Sequence ID No. 1), the complete coding sequence for the NMDAR1-I63 variant NMDAR1 subunit (nucleotides 262–831 of Sequence ID No. 1, plus nucleotides 1–63 of Sequence ID No. 3 and nucleotides 832–3078 of Sequence ID No. 1) and 1220 nucleotides of 3' untranslated sequence (nucleotides 3079–4298 of Sequence ID No. 1). Thus, NMDAR1-I63 differs from NMDAR1 in that it contains 63 nucleotides that are not present in NMDAR1 (nucleotides 1–63 of Sequence ID No. 3), located between nucleotides 831 and 832 of Sequence ID No. 1. The NMDAR1-I63 subunit variant-encoding sequence is operatively linked to the regulatory elements in pcDNA1 for expression in mammalian cells.

F. NMDAR1-I63-Δ204-Δ363

Full-length construct NMDAR1-I63-Δ204-Δ363 was prepared by replacing the 2861 nucleotide fragment from construct NMDAR1-I63-Δ204 (ie, nucleotides 1438–4298 Sequence ID. No. 1) with the KpnI-XbaI (polylinker site) fragment of NMDAR1-Δ363 (ie, nucleotides 1438–2961 and 3325–4298 of Sequence ID No. 1) as depicted in FIG. 2. The NMDAR1-I63-Δ204 was completely digested with XbaI then partially digested with KpnI due to the presence of two additional KpnI sites in the vector sequence. The resulting 5' NMDAR1-I63-Δ204 fragment, which includes the pcDNAI vector sequences, was ligated with the 3' KpnI-XbaI fragment from NMDAR1-Δ363 to generate NMDAR1-I63-Δ204-Δ363.

In summary, construct NMDAR1-I63-Δ204-Δ363 contains 261 base pairs of 5' untranslated sequence (nucleotides 1–261 in Sequence ID No. 1), the complete coding sequence for the NMDAR1-I63-Δ204-Δ363 variant NMDAR1A subunit (nucleotides 262–831 of Sequence ID No. 1, plus nucleotides 1–63 of Sequence ID No. 3, plus nucleotides 832–984, 1189–2961 and 3325–3393 of Sequence ID No. 1) as well as 905 base pairs of 3' untranslated sequence (nucleotides 3394–4298 of Sequence ID. No. 1). Thus, NMDAR1-I63-Δ204-Δ363 differs from NMDAR1A in that it contains 63 nucleotides that are not present in NMDAR1A (nucleotides 1–63 of Sequence ID No. 3) located between nucleotides 831 and 832 of Sequence ID No. 1. Further, NMDAR1-I63-Δ204-Δ363 lacks 204 nucleotides that are present in NMDAR1A (nucleotides 985–1188 of Sequence ID No. 1) and 363 nucleotides that are present in NMDAR1A (nucleotides 2962–3324 of Sequence ID No. 1) that comprise the last 117 nucleotides of the coding sequence and the first 246 nucleotides of the 3' untranslated sequence of NMDAR1A. The NMDAR1-I63-Δ204-Δ363 subunit variant encoding sequence is operatively linked to the regulatory elements in pcDNA1 for expression in mammalian cells.

G. NMDAR1-I63-Δ204-Δ1087

Full-length construct NMDAR1-I63-Δ204-Δ1087 was prepared by replacing the 2861 nucleotide fragment from construct NMDAR1-I63-Δ204 (ie, nucleotides 1438–4298 Sequence ID. No. 1) with the KpnI-XbaI (polylinker site) fragment of NMDAR1-Δ1087 (ie, nucleotides 1438–2961 and 4049–4298 of Sequence ID No. 1) as depicted in FIG. 2. The NMDAR1-I63-Δ204 was completely digested with XbaI then partially digested with KpnI due to the presence of two additional KpnI sites in the vector sequence. The resulting 5' NMDAR1-I63-Δ204 fragment, which includes the pcDNAI vector sequences, was ligated with the 3' KpnI-XbaI fragment from NMDAR1-Δ1087 to generate NMDAR1-I63-Δ204-Δ1087.

In summary, construct NMDAR1-I63-Δ204-Δ1087 contains 261 base pairs of 5' untranslated sequence (nucleotides 1–261 in Sequence ID No. 1), the complete coding sequence for the NMDAR1-I63-Δ204-Δ363 variant NMDAR1A subunit (nucleotides 262–831 of Sequence ID No. 1, plus nucleotides 1–63 of Sequence ID No. 3, plus nucleotides 832–984, 1189–2961 and 4280–4298 of Sequence ID No. 1) as well as 19 base pairs of 3' untranslated sequence (nucleotides 4280–4298 of Sequence ID. No. 1). Thus, NMDAR1-I63-Δ204-Δ1087 differs from NMDAR1A in that it contains 63 nucleotides that are not present in NMDAR1A (nucleotides 1–63 of Sequence ID No. 3) located between nucleotides 831 and 832 of Sequence ID No. 1. Further, NMDAR1-I63-Δ204-Δ1087 lacks 204 nucleotides that are present in NMDAR1A (nucleotides 985–1188 of Sequence ID No. 1) and 1087 nucleotides that are present in NMDAR1A (nucleotides 2962–4048 of Sequence ID No. 1) that comprise the last 117 nucleotides of the coding sequence and the first 970 nucleotides of the 3' untranslated sequence of NMDAR1A. The NMDAR1-I63-Δ204-Δ1087 subunit variant encoding sequence is operatively linked to the regulatory elements in pcDNAI for expression in mammalian cells.

H. Additional Constructs Containing Full-Length cDNAs Encoding Variants of the NMDAR1 Subunit Additional full-length cDNAs encoding further possible NMDAR1 variants can be constructed using methods similar to those described in Examples 2A–G above. Specifically, the following constructs can be prepared by ligating portions of clones NMDA11, NMDA10, NMDA7 and NMDA3 as depicted in FIG. 2:

| | |
|---|---|
| NMDAR1-Δ204 | (Sequence ID No. 1J) |
| NMDAR1-Δ204-Δ363 | (Sequence ID No. 1K) |
| NMDAR1-I63-Δ363 | (Sequence ID No. 1M) |
| NMDAR1-I63-Δ1087 | (Sequence ID No. 1N) |
| NMDAR1-Δ204-Δ1087 | (Sequence ID No. 1L) |

The full-length cDNAs can also be incorporated into mammalian expression vectors such as pcDNA1, as described in Examples 2A–G.

Several methods can be employed to determine which NMDAR1 subunit variants are actually expressed in various human tissues. For example, oligonucleotides specific for the nucleotide sequences located 5' and 3' of the insertions and deletions of the NMDAR1 transcripts described herein can be used to prime nucleic acid amplifications of RNA isolated from various tissues and/or cDNA libraries prepared from various tissues. The presence or absence of amplification products and the sizes of the products indicate which variants are expressed in the tissues. The products can also be characterized more thoroughly by DNA sequence analysis.

RNase protection assays can also be used to determine which variant transcripts are expressed in various tissues. These assays are a sensitive method for detecting and quantitating an RNA species in a complex mixture of total cellular RNA. A portion of the NMDAR1 subunit variant DNA is labeled and hybridized with cellular RNA. If complementary mRNA is present in the cellular RNA, a DNA-RNA hybrid results. The RNA sample is then treated with RNase, which degrades single-stranded RNA. Any RNA-DNA hybrids are protected from RNase degradation and can be visualed by gel electrophoresis and autoradiography.

Further information on possible splice variants of the NMDAR1 primary transcript can be obtained by isolation of genomic clones containing NMDAR1 subunit-encoding sequences (for example, by hybridization to the human NMDAR1 subunit cDNAs disclosed herein) and subsequent characterization of the resulting clones.

EXAMPLE 3

Isolation of DNA Encoding Human NMDA Receptor NMDAR2C Subunits

Degenerate oligonucleotides were synthesized based on two conserved regions of rat NMDAR2A, NMDAR2B and NMDAR2C DNAs that encode the putative first and fourth transmembrane domains. In rat NMDAR2A DNA, these regions are encoded by nucleotides 1669–1692 (oligo SE74) and 2437–2465 (olig SE75), respectively. [see Monyer et al. (1992) *Science* 256:1217–1221]. These oligonucleotides were used to prime nucleic acid amplification of cDNAs prepared from RNA isolated from human hippocampus, cerebellum, and orbitofrontal tissue. Two products, a 795-bp and a 640-bp fragment, were detected when the reaction mixture was analyzed by gel electrophoresis and ethidium bromide staining. The 795-bp fragment amplified from the cerebellum cDNA was subcloned into PCR1000 (Invitrogen, San Diego, Calif.) and characterized by DNA sequence analysis, which revealed that it is ~86% similar to the rat NMDAR2A DNA sequence, ~78% similar to the rat NMDAR2B DNA sequence, and ~74% similar to the rat NMDAR2C DNA sequence. Thus, this plasmid was named pcrNMDAR2A.

The 795-bp insert from pcrNMDAR2A was used to screen $1\times10^6$ recombinants of a human hippocampus cDNA library (prepared by using random primers to synthesize cDNAs from hippocampus tissue and selecting fragments >2.0 kb for insertion into λgt10 vectors) and a human cerebellum cDNA library (random-primed library size-selected for fragments >2.8 kb in λgt10). Hybridization was performed in 5×SSPE, 5×Denhart's solution, 50% deionized formamide, 0.2% SDS, 200 µg/ml sonicated, denatured herring sperm DNA at 42° C. Washes were performed in 1×SSPE, 0.2% SDS at 55° C. The probe hybridized to 11 plaques from the hippocampus library and 8 plaques from the cerebellum library.

DNA sequence analysis and/or restriction enzyme mapping of 15 of the hybridizing plaques that were purified surprisingly revealed that they were more similar to rat NMDAR2C DNA than to rat NMDAR2A DNA. All of the clones were partial cDNAs (i.e., they lacked a translation initiation and/or termination codon) and were designated as NMDAR2C cDNAs. Comparison of the clones revealed that the human NMDAR2C subunit transcript is differentially processed.

Clones NMDA26, NMDA24, NMDA22 and NMDA21 (see FIG. 4) represent four basic clones that were identified, all of which are believed to be splice variants. Clone NMDA26 (nucleotides 1-3025 of Sequence ID No. 5) is used as a reference to which the other variants can be compared. Clone NMDA24 (Sequence ID No. 44 contains a 24-bp sequence (see Sequence ID No. 7) that is not present in NMDA26. Clone NMDA22 (Sequence ID No. 43) lacks 15 bp that are present in NMDA26, and clone NMDA21 (Sequence ID No. 41) lacks 51 bp that are present in NMDA26. Clones NMDA22 and NMDA24 both contain an 11-bp sequence (Sequence ID No. 9) that is not present in NMDA26 (between nucleotides 1116–1117 of Sequence ID No. 5). Introduction of this sequence into these clones (between nucleotides 1116–1117 of Sequence ID No. 5) disrupts the reading frame of the transcript and introduces a premature translation termination (i.e., STOP) codon into the transcript.

Clones NMDA26 and NMDA27 (see FIG. 4) are partial NMDAR2C cDNAs that contain 5' untranslated sequence, a translation initiation codon and some of the coding sequence. Clone NMDA26 contains 188 base pairs of 5' untranslated sequence whereas clone NMDA27 contains ~1.1 kb of 5' untranslated sequence. The sequences of the 5' untranslated regions of these two clones are identical for the first 15 nucleotides proceeding 5' of the translation initiation codon. However, beginning with the 16th nucleotide 5' of the translation initiation codon, the sequences of the two clones diverge (compare nucleotides 116–191 of Sequence ID No. 5 to nucleotides 1–74 of Sequence ID No. 12).

EXAMPLE 4

Preparation of Full-length NMDAR2C Subunit cDNA Constructs

Figure 5:
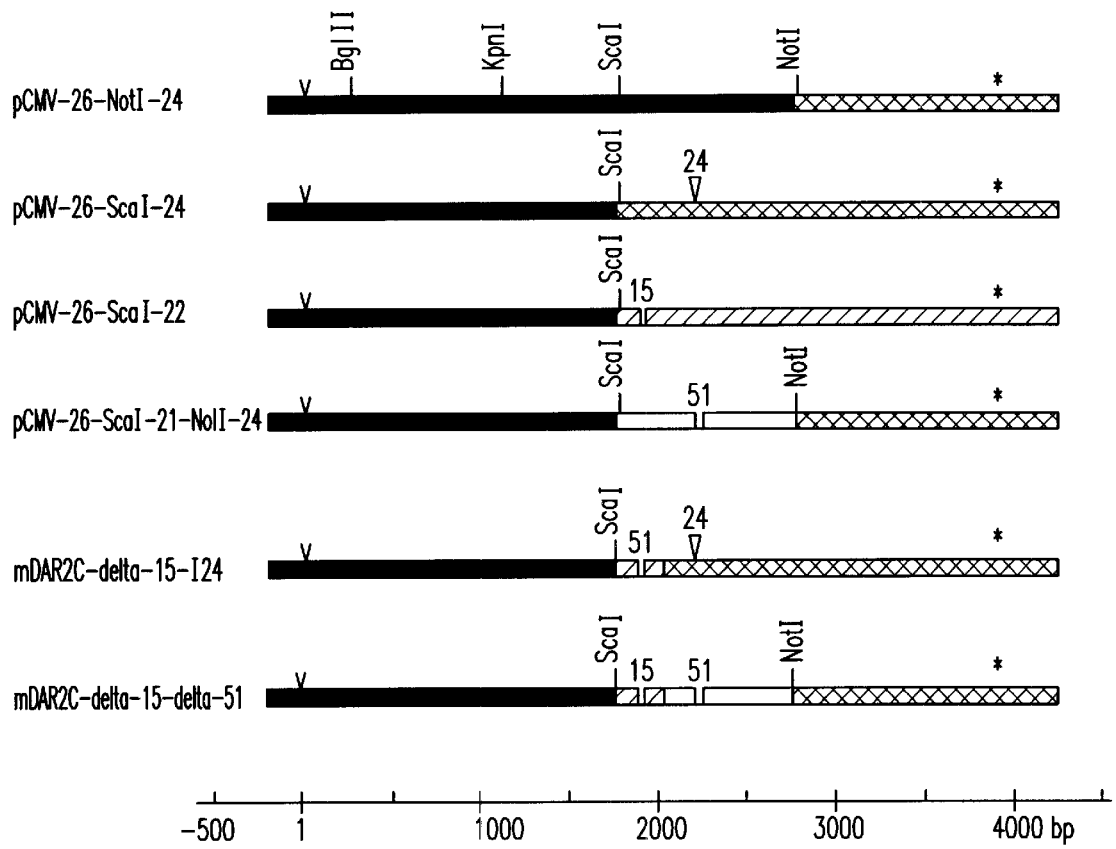
FIG. 5 is a schematic representation of full-length human NMDAR2C subunit subtypes of the invention, with partial restriction maps of each DNA. The full-length cDNAs are constructed by ligation of appropriate portions of the clones shown in FIG. 4. Regions of each full-length cDNA composed of nucleotide sequences corresponding to a particular clone are distinguished as solid, striped, cross-hatched or open boxes.

Portions of the partial NMDAR2C clones can be ligated in a variety of ways to generate constructs encoding full-length NMDAR2C subunit variants. The 5' end of each NMDAR2C cDNA can be contributed by NMDA26, whereas the 3' ends of the constructs are contributed by various combinations of clones NMDA21, NMDA22, and NMDA24. FIG. 5 depicts full-length NMDAR2C constructs and indicates the portions of the different clones that contribute to each construct.

For example, full-length constructs can be prepared using methods such as those described in Example 2 for preparing NMDAR1 constructs. Thus, clone inserts are transferred into a vector (e.g., pcDNA1) for ease of manipulation and then desired portions of the cDNAs are isolated by restriction enzyme digestion of the vectors. This can require several steps and/or partial digests if, for example, there are no unique restriction enzyme sites surrounding the desired portions of the cDNAs. The desired cDNA fragments are then ligated and incorporated into an expression plasmid such as pcDNA1 or pCMV-T7-2.

Plasmid pCMV-T7-2 (see FIG. 6) is a pUC19-based vector that contains a cytomegalovirus (CMV) promoter/ enhancer, SV40 splice donor/splice acceptor sites located immediately downstream of the promoter, a T7 bacteriophage RNA polymerase promoter positioned downstream of the SV40 splice sites, an SV40 polyadenylation signal downstream of the T7 promoter, and a polylinker between the T7 promoter and the polyadenylation signal. This vector thus contains all the regulatory elements required for expression of heterologous DNA in a mammalian host cell, wherein the heterologous DNA has been incorporated into the vector at the polylinker. In addition, because the T7 promoter is located just upstream of the polylinker, this plasmid can be used for synthesis of in vitro transcripts of heterologous DNA that has been subcloned into the vector at the polylinker. Plasmid pCMV-T7-3, also depicted in FIG. 6, is identical to pCMV-T7-2 except that the order of the restriction enzyme sites in the polylinker is reversed. This plasmid can also be used for heterologous expression of NMDAR subunit DNA.

Construct pcDNA1-26-NotI-24-5'UT contains 188 base pairs of 5' untranslated sequence (nucleotides 1–188 of Sequence ID No. 5), the complete coding sequence of the first variant of the human NMDAR2C subunit (nucleotides 189–3899 of Sequence ID No. 5) and ~440 base pairs of 3' untranslated sequence (nucleotides 3900–4340 of Sequence ID No. 5). The NMDAR2C cDNA is contained within the polylinker of expression vector pcDNA1 for expression.

Construct pCMV-26-NotI-24 (Sequence ID No. 5) contains 49 base pairs of 5' untranslated sequence (nucleotides 140–188 of Sequence ID No. 5), the complete coding sequence of a first variant of the human NMDAR2C subunit (nucleotides 189–3899 of Sequence ID No. 5) and ~440 base pairs of 3' untranslated sequence (nuceotides 3900–4340 of Sequence ID No. 5). The NMDAR2C cDNA is contained within the polylinker of expression vector pCMV-T7-2 for expression.

Construct pCMV-26-ScaI-24 (Sequence ID No. 45) is identical to pCMV-26-NotI-24, except it contains 24-base pairs (Sequence ID No. 7) inserted between nucleotides 2350 and 2351 of Sequence ID No. 5.

Construct pCMV-26-ScaI-22 (Sequence ID No. 47) is identical to pCMV-26-NotI-24, except that it lacks 15-base pairs (nucleotides 1960–1974 of Sequence ID No. 5).

Construct pCMV-26-ScaI-21-NotI-24 (Sequence ID No. 49) is identical to pCMV-26-NotI-24, except that it lacks 51-base pairs (nucleotides 2351–2401 of Sequence ID No. 5).

Construct NMDAR2C-Δ15-I24 (Sequence ID No. 51) is identical to pCMV-26-NotI-24, except that it lacks 15-base pairs (i.e., nucleotides 1960–1974 of Sequence ID No. 5) and includes a 24-base pair sequence (i.e., Sequence ID No. 7; inserted between nucleotides 2350 and 2351 of Sequence ID No. 5).

Construct NMDAR2C-Δ15-Δ51 (Sequence ID No. 53) is identical to pCMV-26-NotI-24, except that it lacks 15-base pairs (i.e., nucleotides 1960–1974 of Sequence ID No. 5) and 51-base pairs (i.e., nucleotides 2351–2401 of Sequence ID No. 5).

Additional full-length NMDAR2C constructs can readily be prepared as described herein. For example, 5' untranslated sequence obtained from NMDA27 (instead of NMDA26) can be employed, and the 3' ends of the constructs can be contributed by various combinations of clones NMDA21, NMDA22, and NMDA24.

Several methods (e.g., nucleic acid amplification, RNase protection assays, etc.), as described in Example 2, can be employed to determine which NMDAR2C subunit variants are actually expressed in various human tissues.

Human NMDAR2C has 83.5% GC nucleotide content between nucleotides 2957 and 3166. To potentially enhance NMDAR2C subunit expression, the GC content in this region can be reduced while maintaining the native amino acid sequence. Synthetic DNAs can be made by oligonucleotide primer extension across this region. Four oligonucleotides, SE343 (Sequence ID No. 59), SE344 (Sequence ID No. 60, SE345 (Sequence ID No. 61), and SE346 (Sequence ID No. 62) were synthesized. These primers maintain the amino acid sequence of the human NMDAR2C receptor and some restriction sites, but lower the overall GC content of this region to 53.4%. The criteria for the modification of bases were: 1) to not have more than 4 guanine nucleotides in a row if at all possible, 2) to maintain the restriction cutting sites for NotI (nucleotides 2962–2969 of Sequence ID No. 5), AvaII (nucleotides 3069–3073 Sequence ID No. 5), and AatII (nucleotides 3156–3161 of Sequence ID No. 5), 3) to reduce the secondary structure of the oligonucleotides as much as possible, 4) to not introduce any additional NotI, AvaII or AatII restriction sites into the sequence and 5) to have the basepair overlap between oligonucleotide pairs, {SE343 and SE344} or {SE345 and SE346} have a proposed melting temperature between 62–66° C. The oligonucleotide pair SE343 and SE344 have complementary sequence from nucleotides 51–71 of Sequence ID Nos. 59 and 60. The oligonucleotide pair SE345 and SE346 have complementary sequence from nucleotides 42–61 of Sequence ID No. 61 and nucleotides 43–62 of Sequence ID No. 62, resepectively.

The primer pairs, {SE343 and SE344} and {SE345 and SE346}, are combined in a standard PCR reaction mixture, which contains 50 pmoles of each oligonucleotide, and are amplified according to the following PCR protocol:

Annealing temperature of 55° C. for 1 min extension temperature of 72° C. for 2 min and melting temperature, 96° C. for 30 seconds for 30 cycles.

The resulting 121 bp PCR product from the primer pair SE343-SE344 is digested with NotI and AvaI, and the resulting 103 bp PCR product from the primer pair SE345-SE346 is digested with AvaI and AatII. These fragments are ligated into pCMV-NMDAR2C-26-NotI-24, which has been partially digested with both NotI and AatII due to the presence of additional NotI and/or AatII restriction sites in the vector sequence, to form pCMV-26-NotI-24-GCMOD. This construct, pCMV-26-NotI-24-GCMOD, contains nucleotides 140–2965 of Sequence ID No. 5, followed by the 195 nucleotides set forth in Sequence ID No. 63, and then nucleotides 3161 to 4340 of Sequence ID. No. 5.

EXAMPLE 5

Isolation of DNA Encoding Human NMDA Receptor NMDAR2A Subunits

Two human cDNA libraries were prepared using different oligonucleotides (random and specific primers) to prime cDNA synthesis from RNA isolated from cerebellum tissue. The specific primer used for first-strand synthesis was SE162, nucleotides 904 to 929 of Sequence ID No. 10. cDNAs synthesized by random priming that ranged in size from 1.0–2.8 kb, and cDNAs synthesized by specific priming that ranged in size from 0.6–1.1 kb, were isolated and inserted into the λgt10 phage vector to generate the two libraries.

The random-primed library (3×10$^6$ recombinants) was screened for hybridization to the 795-base pair insert from pcrNMDAR2A (see Example 3) in 5×SSPE, 5×Denhart's solution, 50% deionized formamide, 0.2% SDS, 200 µg/ml sonicated, denatured herring sperm DNA at 42° C. Washes were performed in 1×SSPE, 0.2% SDS at 55° C. The probe hybridized to 11 plaques.

The specifically-primed library ($6\times10^5$ recombinants) was screened for hybridization to oligonucleotide SE177 (nucleotides 859 to 884 of Sequence ID No. 10) in 6×SSPE, 5×Denhart's solution, 10% deionized formamide, 0.2% SDS, 200 µg/ml sonicated, denatured herring sperm DNA at 42° C. Washes were performed in 1×SSPE, 0.2% SDS at 50° C. The probe hybridized to 2 plaques.

Nine of the hybridizing plaques were purified and the inserts were characterized by restriction enzyme mapping and DNA sequence analysis. All clones contained partial cDNAs. Two of the clones, NMDA53 and NMDA54, contain the translation initiation codon and 320 base pairs and 88 base pairs, respectively, of 5' untranslated sequence. The sequences of four other clones, NMDA47, NMDA49, NMDAR50 and NMDA51, along with those of NMDA53 and NMDA54, overlap to comprise ~70% of the human NMDAR2A subunit coding sequence (see nucleotides 1–3084 of Sequence ID No. 10).

To obtain clones containing the remaining ~1300 base pairs of 3' sequence needed to complete the NMDAR2A coding sequence, $6.6\times10^6$ recombinants of an additional human cDNA library (an amplified randomly primed cerebellum cDNA library with inserts ranging from 1.0–2.8 kb in length) were screened for hybridization to an oligonucleotide corresponding to the 3' end of clone NMDA51 (oligo SE171; nucleotide 3454 to 3479 of Sequence ID No. 10) using the same conditions as used for screening the specifically primed cerebellum cDNA library as described above. Four hybridizing plaques were purified and the inserts were characterized by DNA sequence analysis to determine if they contain the 3' end of the coding sequence and a translation termination codon. Two of the clones (NMDA57 and NMDA58, which were determined to be identical), contain a translation termination codon, as determined by DNA sequence analysis. Phage lysate containing clone NMDA57 were deposited under the provisions of the Budapest Treaty with the American Type Culture Collection (ATCC) on Apr. 13, 1993, and assigned Accession No. 75442.

EXAMPLE 6

Preparation of Full-length NMDAR2A Subunit cDNA Constructs

Two separate constructs encoding a full-length NMDAR2A subunit (pCMV-hNMDAR2A-1(53) and pCMV-hNMDAR2A-2 (54) were prepared by ligating portions of the following partial NMDAR2A clones: NMDAR47, NMDAR50, NMDAR58 and either NMDAR53 or NMDAR54 (NMDA53 and NMDAR54 differ only in the amount of 5' untranslated sequence contained in the clones. The inserts of clones NMDA47, NMDA50 and NMDA58 were isolated as EcoRI fragments and ligated with EcoRI-digested pCMV-T7-2 to create pNMDA47, pNMDA50 and pNMDA58, respectively. The inserts of clones NMDA53 and NMDA54 were isolated as XhoI fragments and ligated with SalI-digested pCMV-T7-2 to create pNMDA53 and pNMDA54, respectively.

pNMDA47 was digested with ScaI and NsiI to liberate an ~3,350-bp fragment containing a 3' portion of the β-lactamase gene, which encodes a protein which imparts ampicillin-resistance, and nucleotides 824–2415 of Sequence ID No. 10. This fragment was ligated with a ~2890-bp NsiI/ScaI fragment of pNMDA50 (containing a 5' portion of the β-lactamase gene and nucleotides 2416–3346 of Sequence ID No. 10) to generate pNMDA47+50.

The portion of pNMDA58 that encodes the 3' end of NMDAR2A contains two MscI sites. Because the 3' MscI site is cleaved in preference to the 5' MscI site, partial digestion of pNMDA58 was not an option. Thus, pNMDA58 was digested with ScaI/MscI, and the ~2020-bp fragment containing a 5' portion of the β-lactamase gene and a 3' portion of the insert (nucleotides 4751–4808 of Sequence ID No. 10) was isolated. This fragment was ligated to a ~4150-bp ScaI/MscI fragment of pNMDA47+50 (containing a 3' portion of the β-lactamase gene and nucleotides 824–3212 of Sequence ID No. 10) to generate pNMDA47+50+3'END58. This plasmid contained a complete β-lactamase gene and nucleotides 824–3214 and 4751–4808 of Sequence ID No. 10. To add nucleotides 343–4750 of Sequence ID No. 10 to pNMDA47+50+ 3'END58, pNMDA58 was digested with MscI, and the isolated 1537-bp fragment consisting of nucleotides 3213–4750 of Sequence ID No. 10 was ligated to MscI-digested pNMDA47+50+3'END58. The resulting plasmid, pNMDA47+50+58, contained nucleotides 824–4808 of Sequence ID No. 10.

To generate two constructs containing identical NMDAR2A coding sequences but differing amounts of 5' untranslated sequence, pNMDA53 and pNMDA54 were digested with ScaI/EcoRI to liberate fragments containing a 3' portion of the β-lactamase gene and nucleotides 1–854 and 225–854 of Sequence ID No. 10, respectively. pNMDA47+50+58 was digested with ScaI/EcoRI (partial) and the 3954-bp fragment containing a 5' portion of the β-lactamase gene and nucleotides 855–4808 of Sequence ID No. 10 was separately ligated with the ScaI/EcoRI fragments of pNMDA53 and pNMDA54 to generate pCMV-hNMDAR2A-1(53) and pCMV-hNMDAR2A-2(54), respectively. These two constructs are identical except for the amount of 5' untranslated sequence contained in each. Both contain a full-length NMDAR2A-encoding sequence (nucleotides 311–4705 of Sequence ID No. 10) and 103 nucleotides of 3' untranslated sequence (nucleotides 4706–4808 of Sequence ID No. 10). pCMV-hNMDAR2A-1(53) contains 310 nucleotides of 5' untranslated sequence (nucleotides 1–310 of Sequence ID No. 10), whereas pCMV-hNMDAR2A-2(54) contains 87 nt of 5' untranslated sequence (nucleotides 224–310 of Sequence ID No. 10). The NMDAR2A cDNA is operatively linked to the regulator elements of pCMV-T7-2 for expression in mammalian host cells.

There is no unique restriction site 3' of the NMDAR2A-specific DNA in pCMV-hNMDAR2A-1(53) that can be used to linearize the plasmid in order to prepare in vitro transcripts for injection into Xenopus oocytes. To make a construct that has a unique 3' restriction site (pCMV-hNMDAR2A-3(53)), essentially the entire NMDAR2A-specific DNA of pCMV-hNMDAR2A-1(53) was transferred into vector pCMV-T7-3 as follows. pCMV-NMDAR2A-1 (53) was digested with NotI and the ~4.4-kb fragment was isolated and ligated with NotI-digested pCMV-T7-3 to generate pCMV-hNMDAR2A-3(53).

EXAMPLE 7

Isolation of DNA Encoding Human NMDA Receptor NMDAR2B Subunits

A human fetal brain λZAP cDNA library ($1\times10^6$ recombinants; Stratagene, La Jolla, Calif.) was screened for hybridization to a DNA fragment containing the entire rat NMDAR2B subunit coding sequence (see Monyer et al. (1992) Science 256:1217–1221). Hybridization was conducted in 50% deionized formamide, 5×Denhart's solution, 5×SSPE, 200 µg/ml sonicated, denatured herring sperm DNA and 0.2% SDS at 42° C. Washes were performed in 0.5×SSPE, 0.2% SDS at 65° C. One of the hybridizing clones excised from the human fetal brain library, NMDA81, containing a 5,435 bp insert and translation initiation and termination codons, encodes a full-length NMDAR2B subunit. This excised plasmid, which is in the pBluescript vector, was called pBS-hNMDAR2B.

NMDA81 was digested with EcoRI/EcoRV and the ~5.5-kbp fragment was isolated and ligated to EcoRI/EcoRV-digested pCMV-T7-3. The resulting construct, pCMVPL3-hNMDAR2B, contains the NMDAR2B coding sequence (nucleotides 210–4664 of Sequence ID No. 55), as well as 209 nucleotides of 5' untranslated sequence (nucleotides 1–209 of Sequence ID No. 55) and 339 nucleotides of 3' untranslated sequence (nucleotides 4665–5003 of Sequence ID No. 55). The NMDAR2B-encoding DNA in this construct is operatively linked to regulatory elements in pCMV-T7-3 for expression in mammalian host cells.

EXAMPLE 8

Isolation of DNA Encoding Human NMDA Receptor NMDAR2D subunits

A human fetal brain cDNA library (1×10$^6$ recombinants; Stratagene, La Jolla, Calif.) was screened by subtraction screening methods for DNA encoding a human NMDAR2D receptor subunit. In this method, plaques were selected on the basis of weak or no hybridization to DNAs encoding human NMDAR2A, NMDAR2B and NMDAR2C subunits.

Initially, the library was screened for hybridization to pcrNMDAR2A (see Example 3) under low-stringency conditions (30% deionized formamide, 5×Denhart's solution, 5×SSPE, 200 ng/ml sonicated herring sperm DNA, 0.2% SDS at 42° C.). Washes were also performed using low-stringency conditions (2×SSPE, 0.2% SDS, 50° C.). The filters were stripped, then screened for hybridization to the pcrNMDAR2A fragment and to an ~1200 bp PstI fragment of DNA encoding a human NMDAR2B subunit (see Example 7) and an ~950 bp AccI fragment of DNA encoding a human NMDAR2C subunit (see Example 3). These fragments contain DNA encoding all of the putative transmembrane domains of the subunits. Hybridization was performed under high-stringency conditions (50% deionized formamide, 5×Denhart's solution, 5×SSPE, 200 ng/ml sonicated herring sperm DNA, 0.2% SDS at 42° C.) as were washes (0.1×SSPE, 0.1% SDS, 65° C.).

Eighteen of the plaques that hybridized weakly to pcrNMDAR2A in the initial low stringency screening of the library hybridized only weakly or not at all to portions of DNA encoding human NMDAR2A, NMDAR2B and NMDAR2C subunits in the high stringency screening. The plaques were purified, and the insert fragments were characterized by DNA sequence analysis. One of the inserts, NMDA96, corresponds to the 3' half of the human NMDAR2D subunit gene coding sequence. The sequence of this clone is provided in sequence ID No. 57.

To obtain clones containing the remaining ~2000 bp of 5' sequence needed to complete the NMDAR2D subunit coding sequence, the human fetal brain cDNA library was screened for hybridization to an ~831 bp SmaI fragment of the clone containing the 3' half of the NMDAR2D coding sequence under high stringency hybridization and washing with 0.5×SSPE, 0.2% SDS at 65° C. Nine hybridizing plaques were purified and analyzed by DNA sequencing, which revealed that none of the plaques contain DNA encoding a translation initiation codon and extending 3' to at least the 5' end of the clone containing the 3' half of the NMDAR2D coding sequence.

A human cDNA library was prepared using a specific oligonucleotide, SE296, to prime cDNA synthesis from RNA isolated from human fetal brain. The specific primer used for first-strand synthesis was SE296 (nucleotides 2920–2949 of Sequence ID No. 57. cDNAs synthesized by specific priming that were greater than 2.2 kb in size were isolated and inserted into the λZAPII phage vector to generate the library.

The specifically primed library (1×10$^6$ recombinants) was screened for hybridization to the 831 bp SmaI fragment from NMDAR2D (nucleotides 2435–3265 of Sequence ID No. 57) in 5×SSPE, 5×Denhart's solution, 50% deionized formamide, 0.2% SDS, 200 µg/ml sonicated, denatured herring sperm DNA at 42° C. Washes were performed in 0.1×SSPE, 0.2% SDS at 65° C. One probe hybridized to 11 plaques.

Eleven of the hybridizing plaques were purified, and the inserts characterized by restriction enzyme mapping and DNA sequence analysis. Six of the clones (NMDA111, NMDA112, NMDA115, NMDA116, NMDA119 and NMDA121) contain the translation initiation codon and varying amounts of 5' untranslated sequence.

The sequences of these clones overlap with NMDA96 to constitute 100% of the human NMDAR2D subunit coding sequence (see nucleotides 485–4495 of Sequence ID No. 57).

The full-length hNMDAR2D construct was prepared using NMDA115 and NMDA96 cDNAs. NMDA115 and NMDA96 cDNAs are already in the pBlueScript vector, however the NMDA115 cDNA is in the sense orientation from the T7 promoter, while the NMDA96 cDNA is in the antisense orientation. For ease of subcloning the full-length construct, the NMDA96 cDNA was cloned into the sense orientation by digesting NMDA96 with EcoRI and screening the resulting clones for orientation (NMDAR96-T7). Within the complete human NMDAR2D sequence, there is a unique HindIII at nucleotides 2804 that was used to clone NMDA115 together with NMDA96. However, there is an additional HindIII site in the pBS polylinker at the 5' end of the NMDA115 cDNA. Therefore NMDA115 was fully digested with SpeI, a 3' polylinker site, and partially digested with HindIII. The resulting ~5.6 kb SpeI-HindIII fragment from pNMDA115 (pBS vector plus nucleotides 397–2804 of Sequence ID No. 57)) was ligated with the 1.7 kb HindIII-SpeI fragment (nucleotides 2805–4651 of Sequence ID No. 57) from NMDA96-T7 to form pBS-hNMDAR2D. In vitro transcripts were prepared for co-injection into Xenopus oocytes to test for alteration of NMDAR1A currents.

The complete NMDAR2D insert is then transfered into the pMMTV-T7+ mammalian expression vector as a ~4.7 kb EcoRV/SpeI fragment. The EcoRV and SpeI restriction sites are in the multiple cloning region of the pBluscript vector.

In summary, construct NMDAR2D contains 88 base pairs of 5' untranslated sequence (nucleotides 397–484 in Sequence ID No. 57), the complete coding sequence for the NMDAR2D subunit (nucleotides 484–4495 of Sequence ID No. 57) as well as 200 base pairs of 3' untranslated sequence (nucleotides 4496–4695 of Sequence ID No. 57). The NMDAR2D subunit encoding sequence is operatively linked to the regulatory elements in pMMTV-T7 for expression in mammalian cells.

EXAMPLE 9

Expression of Recombinant Human NMDA Receptor Subunits on Oocytes

Xenopus oocytes were injected with in vitro transcripts prepared from constructs containing DNA encoding human NMDA receptor NMDAR1 and NMDAR2 subunits. Electrophysiological measurements of the oocyte transmembrane currents were made using the two-electrode voltage clamp technique (see e.g., Stuhmer (1992) Meth. Enzymol. 207:319–339).

A. Preparation of In Vitro Transcripts

Recombinant capped transcripts of NMDA receptor subunit cDNAs contained in constructs NMDAR1A, NMDAR1-I63, NMDAR1-I63-Δ204, NMDAR1-Δ1087, NMDAR1-Δ363, and pCMV-26-NotI-24 were synthesized from linearized plasmids using the mCAP RNA Capping Kit (Cat. #200350, Stratagene, Inc., La Jolla, Calif.). For experiments in which NMDAR2A or NMDAR2B and NMDAR1 or NMDAR1-I63 transcripts were co-injected into Xenopus oocytes, the transcripts were synthesized from linearized constructs NMDAR1A, NMDAR1-I63, pCMV-hNMDAR2A-3(53), pCMV-26-NotI-24 and pBS-hNMDAR2B using mMessage mMachine (Ambion, catalog #1344, Austin, Tex.). The mass of each synthesized transcript was determined by UV absorbance and the integrity of each transcript was determined by electrophoresis through an agarose gel.

B. Electrophysiology

Xenopus oocytes were injected with 12.5–50 ng of one or more NMDA receptor subunit transcripts per oocyte. The preparation and injection of oocytes were carried out as described by Dascal [(1987) Crit. Rev. Biochem. 22:317–387]. Two-to-six days following mRNA injection, the oocytes were examined using the two-electrode voltage clamp technique. The cells were bathed in Ringer's solution (115 mM NaCl, 2.5 mM KCl, 1.8 mM $CaCl_2$, 10 mM HEPES, pH 7.3), and the membrane potential was clamped at –80 to –100 mV. Drugs were applied by pipetting 6.0 $\mu$l aliquots of drug-containing solution directly into the bath, or by using gravity-feed into a Warner Instruments chamber (volume=110 $\mu$l) at a flow rate of 8 ml/min. The data were sampled at 2–5 Hz with a Labmaster data acquisition board in a PC-386 using AXOTAPE version 1.2 (Axon Instruments, Foster City, Calif.) software. The data were exported to a laser printer or plotted using Sigmaplot version 5.0.

NMDA agonists, i.e., 10–30 $\mu$M glycine (gly) and 10–100 $\mu$M glutamate (glu) or 100–1000 $\mu$M NMDA, were applied to the bath. If a current response was observed, the agonists were washed from the bath and 0.1–1.0 mM $MgCl_2$ or 1 $\mu$M MK801 (Research Biochemicals, Inc., Natick, Mass.) (NMDA receptor antagonists) were applied before a second agonist application in order to determine whether the current was blocked by antagonists. Alternatively, $MgCl_2$ or MK-801 were applied during agonist-induced current flow. The results of multiple recordings are summarized in Table 1.

TABLE 1

Electrophysiological Analysis of Oocytes Injected with NMDA Receptor Subunit Transcripts

| Transcript (ng injected) | No. Oocytes Responding | Agonists | Peak Current Amplitude |
|---|---|---|---|
| NMDAR1A (12.5) | 6 of 8[a] | 10 $\mu$M gly + 10 $\mu$M glu | 3–40 nA* |
| NMDAR1A (12.5) | 2 of 2[a] | 10 $\mu$M gly + 100 $\mu$M NMDA | 3–8 nA |
| NMDAR1A (12.5) | 0 of 9[a] | 10 $\mu$M gly + 10 $\mu$M glu | |
| NMDAR1A (50) | 0 of 1[a] | 20 $\mu$M gly + 20 $\mu$M glu | |
| NMDAR1A (40) | 4 of 10 | 10 $\mu$M gly + 10 $\mu$M glu | 21.3 ± 20.9 nA* |
| NMDAR1A (40) | 1 of 5 | 10 $\mu$M gly + 100 $\mu$M NMDA | 24 nA* |
| NMDAR1A (40) | 1 of 1 | 10 $\mu$M gly + 100 $\mu$M NMDA | 15.4 nA |
| NMDAR1A (30) | 4 of 9 | 10 $\mu$M gly + 50 $\mu$M glu | 10.6 ± 11.7 nA* |
| NMDAR1A (30) | 0 of 8 | 10–20 $\mu$M gly + 10–100 $\mu$M glu | |
| NMDAR1A (30) | 1 of 4 | 20 $\mu$M gly + 100 $\mu$M NMDA | 10.5 nA |
| NMDAR1A (25–50) | 3 of 3 | 30 $\mu$M gly + 100 $\mu$M glu | 3–10 nA |
| NMDAR1-I63 (12.5) | 1 of 5[a] | 10 $\mu$M gly + 10 $\mu$M glu | ~30 nA* |
| NMDAR1-I63 (50) | 0 of 4[a] | 10 $\mu$M gly + 10 $\mu$M glu | |
| NMDAR1-I63 (40) | 4 of 5 | 10 $\mu$M gly + 10 $\mu$M glu | 13.4 ± 7.1 nA[+] |
| NMDAR1-I63 (40) | 3 of 3 | 10 $\mu$M gly + 20 $\mu$M glu | 17.4 ± 3.7 nA* |
| NMDAR1-I63 (40) | 1 of 1 | 10 $\mu$M gly + 100 $\mu$M glu | 28 nA |
| NMDAR1-I63 (40) | 1 of 1 | 10 $\mu$M gly + 10 $\mu$M NMDA | 1.4 nA[+] |
| NMDAR1-I63 (25–50) | 3 of 3 | 10 $\mu$M gly + 100 $\mu$M glu | 3–5 nA |
| NMDAR1-I63 (40) | 7 of 10 | 10 $\mu$M gly + 100 $\mu$M NMDA | 8.1 ± 3.0 nA[+] |
| NMDAR1-I63 (40) | 1 of 2 | 10 $\mu$M gly + 1000 $\mu$M NMDA | 16.4 nA[+] |
| NMDAR1-I63-Δ204 (12.5) | 0 of 8[a] | 10 $\mu$M gly + 10 $\mu$M glu | |
| NMDAR1-I63-Δ204 (50) | 1 of 5[a] | 20 $\mu$M gly + 20 $\mu$M glu | ~50 nA |
| NMDAR1-Δ1087 (50) | 3 of 13 | 10 $\mu$M gly + 10 $\mu$M glu | 4–11 nA* |
| NMDAR1A (39) + pCMV-26-NotI-24 (39) | 1 of 5 | 10 $\mu$M gly + 50 $\mu$M glu | 10 nA |
| NMDAR1A (30) + pCMV-26-NotI-24 (30) | 0 of 7 | 10 $\mu$M gly + 20 $\mu$M glu | |
| NMDAR1 (32) + pcDNAI-26-NotI-24-5' UT (50) | 4 of 5 | 10 $\mu$M gly + 10 $\mu$M glu | 15.8 ± 2.6 nA |
| NMDAR1A (25–50) + pCMV-hNMDAR-2A-3 (53) (25–50) | 16 of 29 | 30 $\mu$M gly + 100 $\mu$M glu | 40 nA–3.4 $\mu$A |
| NMDAR1-I63 (25–50) + pCMV- | 6 of 11 | 10 $\mu$M gly + 100 $\mu$M glu | 10–100 nA |

TABLE 1-continued

Electrophysiological Analysis of Oocytes Injected with
NMDA Receptor Subunit Transcripts

| Transcript (ng injected) | No. Oocytes Responding | Agonists | Peak Current Amplitude |
|---|---|---|---|
| hNMDAR-2A-3 (53) (25–50) | | | |
| NMDAR1A (25) + pBS-hNMDAR2B (25) | 4 of 5 | 30 μM gly + 30 μM glu | >100 nA |
| NMDAR1A (50) + pCMV-hNMDAR-2A-3 (50) + pCMV-26-NotI-24 (50) | 15 of 22 | 100 μM NMDA + 30 μM gly - or - 100 μM NMDA + 100 μM gly | 137.7 nA 1340.1 nA |

<sup>a</sup>Oocytes were unhealthy (i.e., the holding current was large)
*The agonist-induced currents in at least 1 cell were blocked by 100 μM MgCl₂.
†The agonist-induced currents in at least 1 cell were blocked by 1.0 μM MK801.

Analysis of the results shown in Table 1 indicates that, in general, the NMDA agonist-induced currents were blocked by either MgCl$_2$ or MK801.

Oocytes injected with transcripts (12.5 to 65 ng) of the NMDAR-1 subunit-encoding inserts of constructs NMDAR1A, NMDAR1-I63 or NMDAR1-Δ363 were further analyzed to evaluate human NMDA receptor sensitivity to glutamate and NMDA. The two-electrode voltage clamp methods described above were used to measure current in the cells.

To determine glutamate and NMDA sensitivity of the recombinant human NMDA receptors, various concentrations of glutamate (0.1–100 μM) or NMDA (3–1000 μM) were applied to the bath (in the presence of 10–30 μM glycine) and the current response was recorded. The bath was flushed between agonist applications. Intermediate test applications of 10 μM glycine plus 10 μM glutamate were included in the experiments to monitor the receptors for run-down (i.e., inactivation of receptors that have been repeatedly activated during prolonged electrophysiological recording). The data were used to generate dose-response curves from which EC$_{50}$ values for the two agonists were calculated. Glycine sensitivity was determined in the same manner except that various concentrations (0.1–100 μM) of glycine were co-applied with 100 μM NMDA.

The EC$_{50}$ values determined for glutamate stimulation of NMDA receptors expressed in oocytes injected with NMDAR1A, NMDAR1-I63 or NMDAR1-Δ363 transcripts were 0.4, 0.6 and 0.5 μM, respectively. The EC$_{50}$ values determined for NMDA stimulation of NMDA receptors expressed in oocytes injected with NMDAR1A, NMDAR1-I63 or NMDAR1-Δ363 transcripts were 6.3, 10.9 and 11.9 μM, respectively.

There was a marked potentiation of the current magnitude in response to glutamate and glycine in oocytes co-injected with in vitro transcripts of pCMV-hNMDAR2A-3(53) and NMDAR1A or NMDAR1-I63 compared to the currents recorded in oocytes injected with transcripts of either NMDAR1A or NMDAR1-I63 alone. Similarly, there was a marked potentiation of the current magnitude in response to glutamate and glycine in oocytes co-injected with in vitro transcripts of NMDAR1A and pBS-hNMDAR2B compared to the currents recorded in oocytes injected with only the NMDAR1A transcript.

To investigate the pharmacological properties of human NMDA receptors generated by coexpression of the human NMDAR1A, NMDAR2A and NMDAR2C subunits, oocytes were co-injected with 50 ng each of in vitro transcripts prepared from the NMDAR1A, pCMV-hNMDAR2A-3, and pCMV-26-NotI-24 (NMDAR2C) constructs. The sensitivity of the recombinant heteromeric receptors to glycine and NMDA was determined as described above. The EC$_{50}$ for glycine activation of inward currents in these recombinant oocytes was calculated from the dose-response curve to be 0.87±0.24 μM (mean±S.D. of 4 oocytes), which was significantly different than the EC$_{50}$ calculated for glycine sensitivity of oocytes injected with 50 ng each of in vitro transcripts of NMDAR1A and pCMV-hNMDAR2A-3 alone (1.9±0.26 μM, ; p=0.0002, one-tailed t-test). The sensitivity to NMDA also increased when human NMDAR2C was co-expressed with human NMDAR1A and NMDAR2A subunits. The EC$_{50}$ for NMDA was shifted from 30.2±9.4 μM for oocytes co-injected with 50 ng each of in vitro transcripts of NMDAR1A and pCMV-hNMDAR2A-3 to 11.9±5.2 μM for oocytes co-injected with 50 ng each of in vitro transcripts of NMDAR1A, pCMV-hNMDAR2A-3 and pCMV-26-NotI-24 (mean±S.D. of 4 oocytes).

EXAMPLE 10

Recombinant Expression of Human NMDA Receptor Subunits in Mammalian Cells

Mammalian cells, such as human embryonic kidney (HEK293) cells can be transiently and/or stably transfected with DNA encoding human NMDA receptor subunits (e.g., DNA encoding an NMDAR1 subunit or DNA encoding an NMDAR1 subunit and DNA encoding an NMDAR2 subunit such as pCMV-26-NotI-24, pCMV-hNMDAR2A-3(53) or pCMVPL3-hNMDAR2B). Transfectants are analyzed for expression of NMDA receptors using various assays, e.g., northern blot hybridization, electrophysiological recording of cell currents, Ca$^{2+}$-sensitive fluorescent indicator-based assays and [$^H$]-MK801 binding assays.

A. Transient Transfection of HEK Cells

Two transient transfections were performed. In one transfection, HEK 293 cells were transiently transfected with DNA encoding an NMDAR1 (construct NMDAR1A) subunit. In another transfection, HEK 293 cells were transiently co-transfected with DNA encoding NMDAR1 (construct NMDAR1A) and NMDAR2C (pCMV-26-NotI-24) subunits. In both transfections, ~2×10$^6$ HEK cells were transiently transfected with 19 μg of the indicated plasmid(s) according to standard CaPO$_4$ transfection procedures [Wigler et al. (1979) Proc. Natl. Acad. Sci. USA 76:1373–1376]. In addition, 1 μg of plasmid pCMVβgal (Clontech Laboratories, Palo Alto, Calif.), which contains the *Escherichia coli* β-galactosidase gene fused to the CMV promoter, were co-transfected as a reporter gene for monitoring the efficiency of transfection. The transfectants were analyzed for β-galactosidase expression by direct staining of the product of a reaction involving β-galactosidase and the X-gal substrate [Jones (1986) *EMBO* 5:3133–3142]. Transfectants can also be analyzed for β-galactosidase expression by measurement of β-galactosidase activity [Miller (1972) in *Experiments in Molecular Genetics*, pp.352–355, Cold Spring Harbor Press].

The efficiency of these transfections of HEK cells was typical of standard efficiencies (i.e., ~50%).

B. Stable Transfection of Mammalian Cells

Mammalian cells, such as HEK 293 cells, can be stably transfected using the calcium phosphate transfection procedure [*Current Protocols in Molecular Biology*, Vol. 1, Wiley Inter-Science, Supplement 14, Unit 9.1.1–9.1.9 (1990)]. Ten-cm plates, each containing 1–2×10$^6$ cells, are transfected with 10 ml of DNA/calcium phosphate precipitate in media containing approximately 19 μg of NMDA receptor subunit-encoding DNA and 1 μg of DNA encoding a selectable marker, for example, neomycin-resistance gene (i.e., pSV2neo). After ~14 days of growth in media containing typically 1 μg/ml G418, colonies form and are individually isolated using cloning cylinders. The isolates are then subjected to limiting dilution and screened to identify those that express NMDA receptors using, for example, methods described below.

C. Analysis of Transfectants

1. Northern Blot Hybridization Analysis

Total RNA was isolated from ~1×10$^7$ HEK cells co-transfected with NMDAR1 and pCMV-26-NotI-24, and 5–10 μg of RNA was used for northern hybridization analysis. Fragments from human neuronal NMDAR subunit-encoding plasmids were randomly primed and labeled with $^{32}$P-dCTP Klenow incorporation and used as probes. The northern blot hybridization and wash conditions were as follows:

hybridization in 5×SSPE, 5×Denhart's solution, 50% formamide, at 42° C. followed by washing in 0.2× SSPE, 0.1% SDS, at 65° C.

Results of these studies revealed the transfectants expressed detectable levels of NMDAR1 and NMDAR2C mRNA of the appropriate size (based on the size of the cDNAs).

2. Fluorescent Indicator-based Assays

Activation of ligand-gated NMDA receptors by agonists leads to an influx of cations (both monovalent and divalent), including $Ca^{2+}$, through the receptor channel. Calcium entry into the cell through the channel can in turn induce release of calcium contained in intracellular stores. Monovalent cation entry into the cell through the channel can also result in an increase in cytoplasmic calcium levels through depolarization of the membrane and subsequent activation of voltage-dependent calcium channels. Therefore, methods of detecting transient increases in intracellular calcium concentration can be applied to the analysis of functional NMDA receptor expression. One method for measuring intracellular calcium levels relies on calcium-sensitive fluorescent indicators.

Calcium-sensitive indicators, such as fluo-3 (Catalog No. F-1241, Molecular Probes, Inc., Eugene, Oreg.) are available as acetoxymethyl esters which are membrane permeable. When the acetoxymethyl ester form of the indicator enters a cell, the ester group is removed by cytosolic esterases, thereby trapping the free indicator in the cytosol. Interaction of the free indicator with calcium results in increased fluorescence of the indicator; therefore, an increase in the intracellular $Ca^{2+}$ concentration of cells containing the indicator can be expressed directly as an increase in fluorescence. An automated fluorescence detection system for assaying NMDA receptors has been described in commonly assigned pending U.S. patent application Ser. No. 07/812,254 and corresponding PCT Patent Application No. US92/11090, incorporated by reference herein in their entirety.

Mammalian cells that have been transfected with DNA encoding NMDAR1 or NMDAR1 and NMDAR2 subunits can be analyzed for expression of functional recombinant NMDA receptors using the automated fluorescent indicator-based assay. The assay procedure is as follows.

Untransfected mammalian host cells (or host cells transiently transfected with pCMV-T7-2) and mammalian cells that have been transfected with NMDAR1±NMDAR2 subunit DNA are plated in the wells of a 96-well microtiter dish (Nunc Catalog No. 1-6708, available through Alameda Industries, Escondido, Calif.) that has been precoated with poly-L-lysine at a density of 2.5×10$^5$ cells/well and loaded with fluo-3 by incubation for 2 hours at 20° C. in a medium containing 20 μM fluo-3, 0.2% Pluronic F-127 in HBS (125 mM NaCl, 5 mM KCl, 1.8 mM $CaCl_2$, 0.62 mM $MgCl_2$, 20 mM glucose, 20 mM HEPES, pH 7.4). The cells are then washed with assay buffer (i.e. HBS). The microtiter dish is then placed into a fluorescence plate reader (e.g., Fluoroskan II, Lab Products International, Ltd., Raleigh, N.C.) and the basal fluorescence of each well is measured and recorded before addition of 10 μM glycine and 10 μM glutamate to the wells. The fluorescence of the wells is monitored repeatedly (75 readings at 0.63-sec intervals) following addition of agonist.

The fluorescence of the untransfected host cells preferably will not change after addition of glycine and glutamate, i.e., the host cells should not express endogenous excitatory amino acid receptors. The fluorescence of mammalian cells transfected with NMDAR1±NMDAR2 subunit DNA will increase after addition of glycine and glutamate if a sufficient number of functional NMDA receptors are expressed at the cell surface, and fluorescence readings are taken rapidly.

The resting potential of the membrane of some mammalian host cells may be relatively positive (e.g., −35 mV). Because activation of some NMDA receptors may be significantly reduced at relatively positive potentials, it may be necessary to lower the resting potential of the membrane of cells transfected with human NMDA receptor subunit-encoding DNAs prior to assaying the cells for NMDA receptor activity using the fluorescent indicator-based assay. This may be accomplished by adding valinomycin (~10 μM) to the transfected cells prior to adding NMDA receptor agonists to initiate the assay.

3. NMDA Receptor Ligand Binding Assays

Mammalian cells transfected with NMDAR1±NMDAR2 subunit DNAs can be analyzed for [$^3$H]-MK801 binding. An additional ligand-binding assay for NMDA receptors using $^3$H-CGP39653 is also described below. Rat brain membranes are included in the binding assays as a positive control.

a. Preparation of Membranes i. Buffy coat Homogenate from Rat Cerebral Cortex

Buffy coat membranes are prepared from rat brain cortices as described by Jones et al. [(1989) *J. Pharmacol. Meth.* 21:161]. Briefly, cortices from ten freshly thawed frozen rat brains are dissected and weighed. The tissue is homogenized in 20 volumes of 0.32 M ice-cold sucrose in a glass homogenizing tube using a Teflon pestle. The suspension is centrifuged at 1,000×g for 10 minutes at 4° C. The supernatant is decanted and centrifuged at 20,000×g for 20 minutes at 4° C. The pellet is resuspended in 20 volumes of ice-cold distilled water with a Polytron for 30 sec at setting 6. The suspension is centrifuged at 8,000×g for 20 minutes at 4° C. The buffy coat pellet is rinsed gently with supernatant and then recentrifuged at 48,000×g for 20 minutes at 4° C. The pellet is resuspended in 20 volumes of ice-cold distilled water with a Polytron and centrifuged again at 48,000×g for 20 minutes. The wash step is repeated once more. The final suspension is divided into aliquots, centrifuged. Each pellet can be stored frozen at −20° C. for 12 hrs or more before use.

ii. Membranes from Transfected and Untransfected Mammalian Cells

In order to prepare membranes from transfected and untransfected mammalian cells, the cells are scraped from the tissue culture plates, and the plates are rinsed with 5 ml of PBS (phosphate-buffered saline: 137 mM NaCl, 2.7 mM KCl, 10 mM $Na_2HPO_4$, 1.7 mM $KH_2PO_4$). The cells are centrifuged at low speed in a table-top centrifuge, and the cell pellet is rinsed with PBS. The cell pellet is resuspended in 20 ml of 10 mM Hepes buffer, pH 7.4, using a Polytron at setting 3–6 for 30 seconds. The cell suspension is centrifuged at 48,000×g for 20 minutes at 4° C. The supernatant is discarded, and the pellet is kept frozen for 12 hrs or more at −20° C.

b. [$^3$H]-MK801 Binding to NMDA Receptors

The binding of [$^3$H]-MK801 to NMDA receptors is carried out as described by Wong et al. [(1986) *Proc. Natl. Acad. Sci. USA* 83:7104], with a few minor changes. Thus, on the day of the assay, the rat brain and mammalian cell (transfected and untransfected) membrane pellets are resuspended in 50 volumes of 10 mM Hepes buffer, pH 7.4, using a 10-ml syringe and a 21-gauge needle, and incubated for 20 minutes at 37° C. The supernatant is centrifuged at 48,000×g for 20 minutes at 4° C. The pellet is resuspended in 2 ml of 10 mM Hepes, pH 7.4 and centrifuged as described above. The wash step is repeated once more, and the pellet is resuspended in 10 ml of 10 mM Hepes, pH 7.4. The protein concentration is determined using the Biorad Bradford reagent. The pellet is finally resuspended in the assay buffer (10 mM Hepes, pH 7.4) at 1 mg/ml.

For binding studies, the membrane suspension is incubated in duplicate with 2.5 nM [$^3$H]-MK801 (New England Nuclear, Boston, Mass.) in a total volume of 0.5 ml assay buffer (10 mM Hepes, pH 7.4) in the presence and absence of 10 $\mu$M glutamate and 10 AM glycine for 60 or 120 min at 23° C. Bound radioactivity is separated from free radioactivity by rapid filtration through Whatman GF/C filters which are presoaked for 2–3 hrs in 0.05% polyethylenimine. The filters are washed twice with 3 ml ice-cold assay buffer. The filters are dried and transferred to scintillation vials, each containing 10 ml of scintillation fluid. The vials are vortexed, and the radioactivity is measured in a Beckman scintillation counter. The nonspecific binding observed in the presence of 10 $\mu$M MK801 is subtracted from the total binding in order to determine the specific binding.

Rat brain cortical buffy coat membranes displayed specific saturable binding of [$^3$H]-MK801. In the presence of glycine and glutamate, the ratio of total-to-nonspecific binding (S:N ratio) was 28:1, whereas in the absence of glutamate and glycine the S:N ratio was 5:1. Thus, the binding of MK801 to rat NMDA receptors is potentiated by glutamatergic agonists. Scatchard analysis of [$^3$H]-MK801 binding to rat brain membranes indicated that the sensitivity of the assay was 90 fmoles of receptor.

c. [$^3$H]-CGP39653 Binding to NMDA Receptors

The binding of [$^3$H]-CGP39653 to rat brain membranes is carried out as described by Sills et al. [(1991) *Eur. J. Pharmacol.* 192:19]. The buffy coat membrane pellet is resuspended in 50 volumes of 5 mM Tris-HCl containing 10 mM EDTA, pH 7.7, and incubated for 10 min. at 37° C. The supernatant is centrifuged at 48,000×g for 10 min. at 4° C. The wash step is repeated once and the pellet is resuspended in 10 ml of 5 mM Tris-HCl containing 10 mM EDTA, pH 7.7. This rat brain membrane suspension is incubated in duplicate or triplicate with 2.0 nM [$^3$H]-CGP39653 (New England Nuclear) in a total volume of 0.5 ml assay buffer (5 mM Tris-HCl, pH 7.7) for 60 min at 0° C. Nonspecific binding is determined in the presence of 100 $\mu$M glutamate. Bound radioactivity is separated from the free by vacuum filtration through GF/C filters which are presoaked for 2–3 hrs in 0.05% polyethylenimine, using the filtration manifold. Unbound radioactivity is removed with two washes of 3 ml each of ice-cold buffer. The filters are dried and transferred to scintillation vials, each containing 10 ml of scintillation fluid. The vials are vortexed, and the radioactivity is measured in a Beckman scintillation counter. The nonspecific binding observed in the presence of 100 $\mu$M glutamate is subtracted from the total binding to determine the specific binding.

[$^3$H]-CGP39653 binding was first measured as a function of membrane concentration. Specific binding increased linearly with increasing membrane concentration up to 200 $\mu$g of protein in the presence of 2 nM [$^3$H]-CGP39653.

Saturation analysis of [$^3$H]-CGP39653 binding was carried out by incubating 150 $\mu$g of rat buffy coat homogenate with increasing concentrations of [$^3$H]-CGP39653 for 60 min at 4° C. Scatchard analysis indicated a single class of binding sites with a $B_{max}$ value of 0.69±0.09 pmoles/mg and a $K_d$ value of 12.3±0.12 nM.

While the invention has been described in detail with reference to certain preferred embodiments thereof, it will be understood that modifications and variations are within the spirit and scope of that which is described and claimed.

Summary of Sequences

Sequence ID No. 1 is a nucleotide sequence encoding a human N-methyl-D-aspartate (NMDA) receptor subunit, NMDAR1A, and the deduced amino acid sequence thereof.

Clone NMDA10 encodes a 3083 nucleotide sequence comprising nucleotides 320-3402 of Sequence ID No. 1. Thus, this sequence encoded by the NMDA1D clone differs from Sequence ID No. 1 in that it does not contain the 319 5' nucleotides, nor the 896 3' nucleotides thereof.

Sequence ID No. 13 is a 3155 nucleotide sequence encoded by clone NMDA11, comprising nucleotides 1–2961, plus nucleotides 3325–3518 of Sequence ID No. 1. Thus, Sequence ID No. 13 differs from Sequence ID No. 1 by the deletion of 363 nucleotides from the 3' portion thereof (i.e., by the deletion of nucleotides 2962–3324 of Sequence ID No. 1), and further by the lack of the 781 terminal 3' nucleotides of Sequence ID No. 1.

Sequence ID No. 15 is a 2542 nucleotide sequence encoded by clone NMDA7, comprising nucleotides 556–831 of Sequence ID No. 1, plus an additional 63 nucleotides (set forth in Sequence ID No. 3) and nucleotides 832–984, 1189–2961 and 3325–3599 of Sequence ID No. 1. Thus, Sequence ID No. 15 differs from Sequence ID No. 1 in that it does not contain the 555 5'-most nucleotides thereof, it does not contain the 204 nucleotides set forth as nucleotides 985–1188 of Sequence ID No. 1, it does not contain the 363 3' nucleotides set forth as nucleotides 2962–3324 of Sequence ID No. 1, and it does not contain the 700 3'-most nucleotides of Sequence ID No. 1, while it does contain an additional 63 nucleotides (Sequence ID No. 3) inserted between nucleotides 831 and 832 of Sequence ID No. 1.

Sequence ID No. 17 is a 593 nucleotide sequence encoded by clone NMDA3, comprising nucleotides 2617–2961, plus nucleotides 4049–4298 of Sequence ID No. 1. Thus, Sequence ID No. 17 differs from Sequence ID No. 1 in that it does not contain the 2616 5' nucleotides thereof, and by the deletion of 1087 nucleotides from the 3' portion thereof (i.e., by the deletion of nucleotides 2962–4048 of Sequence ID No. 1).

Sequence ID No. 19 is a nucleotide sequence encoding human NMDA receptor subunit NMDAR1-Δ363, comprising nucleotides 1–2961, plus nucleotides 3325–4298 of Sequence ID No. 1. Thus, Sequence ID No. 19 differs from Sequence ID No. 1 in that it does not contain the 363 nucleotides set forth as nucleotides 2962–3324 of Sequence ID No. 1.

Sequence ID No. 21 is a nucleotide sequence encoding human NMDA receptor subunit NMDAR1-Δ1087, comprising nucleotides 1–2961, plus nucleotides 4049–4298 of Sequence ID No. 1. Thus, Sequence ID No. 21 differs from Sequence ID No. 1 in that it does not contain the 1087 nucleotides set forth as nucleotides 2962–4048 of Sequence ID No. 1.

Sequence ID No. 23 is a nucleotide sequence encoding human NMDA receptor subunit NMDAR1-I63. Sequence ID No. 23 is the same as Sequence ID No. 1, further comprising an additional 63 nucleotides (set forth in Sequence ID No. 3) inserted between nucleotides 831 and 832 of Sequence ID No. 1.

Sequence ID No. 25 is a nucleotide sequence encoding human NMDA receptor subunit NMDAR1-I63-Δ204. Sequence ID No. 25 is the same as Sequence ID No. 23 except Sequence ID No. 25 does not contain the 204 nucleotides set forth as nucleotides 985–1188 of Sequence ID No. 1.

Sequence ID No. 27 is a nucleotide sequence encoding human NMDA receptor subunit NMDAR1-I63-Δ204-Δ363. Sequence ID No. 27 is the same as Sequence ID No. 25 except Sequence ID No. 27 does not contain the 363 nucleotides set forth as nucleotides 2962–3324 of Sequence ID No. 1.

Sequence ID No. 29 is a nucleotide sequence encoding human NMDA receptor subunit NMDAR1-Δ204. Sequence ID No. 29 is the same as Sequence ID No. 1, except Sequence ID No. 29 does not contain the 204 nucleotides set forth as nucleotides 985–1188 of Sequence ID No. 1.

Sequence ID No. 31 is a nucleotide sequence encoding human NMDA receptor subunit NMDAR1-Δ204-Δ363. Sequence ID No. 31 differs from Sequence ID No. 1 in that Sequence ID No. 31 does not contain the 204 nucleotides set forth as nucleotides 985–1188 of Sequence ID No. 1, nor the 363 nucleotides set forth as nucleotides 2962–3324 of Sequence ID No. 1.

Sequence ID No. 33 is a nucleotide sequence encoding human NMDA receptor subunit NMDAR1-Δ204-Δ1087. Sequence ID No. 33 differs from Sequence ID No. 1 in that Sequence ID No. 33 does not contain the 204 nucleotides set forth as nucleotides 985–1188 of Sequence ID No. 1, nor the 1087 nucleotides set forth as nucleotides 2962–4048 of Sequence ID No. 1.

Sequence ID No. 35 is a nucleotide sequence encoding human NMDA receptor subunit NMDAR1-I63-Δ363. Sequence ID No. 35 is the same as Sequence ID No. 23 except Sequence ID No. 35 does not contain the 363 nucleotides set forth as nucleotides 2962–3324 of Sequence ID No. 1.

Sequence ID No. 37 is a nucleotide sequence encoding human NMDA receptor subunit NMDAR1-I63-Δ1087. Sequence No. 37 is the same as Sequence ID No. 25 except Sequence ID No. 37 does not contain the 1087 nucleotides set forth as nucleotides 2962–4048 of Sequence ID No. 1.

Sequence ID No. 39 is a nucleotide sequence encoding human NMDA receptor subunit NMDAR1-I63-Δ204-Δ1087. Sequence ID No. 39 is the same as Sequence ID No. 25 except Sequence ID No. 39 does not contain the 1087 nucleotides set forth as nucleotides 2962–4048 of Sequence ID No. 1.

Sequence ID No. 2 is the amino acid sequence of the NMDA receptor subunit set forth in Sequence ID No. 1.

Sequence ID No. 14 is the amino acid sequence of an NMDA receptor subunit encoded by the nucleotide sequence of Sequence ID No. 13.

Sequence ID No. 16 is the amino acid sequence of a portion of an NMDA receptor subunit encoded by the nucleotide sequence of Sequence ID No. 15.

Sequence ID No. 18 is the amino acid sequence of a portion of an NMDA receptor subunit as encoded by the nucleotide sequence of Sequence ID No. 17.

Sequence ID No. 20 is the amino acid sequence of an NMDA receptor subunit encoded by the nucleotide sequence of Sequence ID No. 19.

Sequence ID No. 22 is the amino acid sequence of an NMDA receptor subunit encoded by the nucleotide sequence of Sequence ID No. 21.

Sequence ID No. 24 is the amino acid sequence of an NMDA receptor subunit encoded by the nucleotide sequence of Sequence ID No. 23.

Sequence ID No. 26 is the amino acid sequence of an NMDA receptor subunit encoded by the nucleotide sequence of Sequence ID No. 25.

Sequence ID No. 28 is the amino acid sequence of an NMDA receptor subunit encoded by the nucleotide sequence of Sequence ID No. 27.

Sequence ID No. 30 is the amino acid sequence of an NMDA receptor subunit encoded by the nucleotide sequence of Sequence ID No. 29.

Sequence ID No. 32 is the amino acid sequence of an NMDA receptor subunit encoded by the nucleotide sequence of Sequence ID No. 31.

Sequence ID No. 34 is the amino acid sequence of an NMDA receptor subunit encoded by the nucleotide sequence of Sequence ID No. 33.

Sequence ID No. 36 is the amino acid sequence of an NMDA receptor subunit encoded by the nucleotide sequence of Sequence ID No. 35.

Sequence ID No. 38 is the amino acid sequence of an NMDA receptor subunit encoded by the nucleotide sequence of Sequence ID No. 37.

Sequence ID No. 40 is the amino acid sequence of an NMDA receptor subunit encoded by the nucleotide sequence of Sequence ID No. 39.

Sequence ID No. 3 is a nucleotide sequence encoding the 63 nucleotide insert present in Sequence ID Nos. 15, 23, 25, 27, 35, 37 and 39.

Sequence ID No. 4 is the 21 amino acid sequence encoded by the insert set forth in Sequence ID No. 3.

Sequence ID No. 5 is a nucleotide sequence of a clone (pCMV-26-NotI-24) encoding a human N-methyl-D-aspartate (NMDA) receptor subunit, NMDAR2C, and the deduced amino acid sequence thereof.

Sequence ID No. 41 is a 2026 nucleotide sequence encoded by clone NMDA21, comprising nucleotides 931–2350, and 2402–3307 of Sequence ID No. 5. Thus, Sequence ID No. 41 differs from Sequence ID No. 5 in that it does not contain the 930 5' nucleotides thereof, nor the 51 nucleotides located at position 2351–2401 of Sequence ID No. 5, nor the 1061 3' nucleotides of Sequence ID No. 5.

Sequence ID No. 43 is a 3698 nucleotide sequence encoded by clone NMDA22, comprising nucleotides 367–1300 of Sequence ID No. 5, plus an additional 11 nucleotides (set forth as Sequence ID No. 9), and nucleotides 1301–1959 and 1975–4068 of Sequence ID No. 5. Thus, Sequence ID No. 43 differs from Sequence ID No. 5 by the lack of the 366 5'-most nucleotides, by the insertion of 11 nucleotides between nucleotides 1300 and 1301 of Sequence ID No. 5, and further by the lack of the 15 nucleotides of Sequence ID No. 5 from residue 1960 to residue 1974.

Sequence ID No. 44 is a 3243 nucleotide sequence encoded by clone NMDA24, comprising nucleotides 861–1300 of Sequence ID No. 5, plus an additional 11 nucleotides (Sequence ID No. 9), nucleotides 1301–2350 of Sequence ID No. 5, an additional 24 nucleotides (set forth as Sequence ID No. 7) and nucleotides 2351–4068 of Sequence ID No. 5. Thus, Sequence ID No. 44 differs from Sequence ID No. 5 in that it does not contain the 860 5'-most nucleotides thereof, while it does contain an additional 11 nucleotides (Sequence ID No. 9) inserted between nucleotides 1300 and 1301, plus an additional 24 nucleotides (Sequence ID No. 7) inserted between nucleotides 2350 and 2351 of Sequence ID No. 5.

Nucleotides 1-3025 of Sequence ID No. 5 are a 3025 nucleotide sequence encoded by clone NMDA26. Thus, this sequence differs from Sequence ID No. 5 in that it does not contain the 1043 3'-terminal nucleotides thereof.

Sequence ID No. 45 is a nucleotide sequence encoding human NMDA receptor subunit pCMV-26-ScaI-24, which differs from Sequence ID No. 5 only in the insertion of 24 nucleotides (Sequence ID No. 7) between nucleotides 2350 and 2351 of Sequence ID No. 5.

Sequence ID No. 47 is a nucleotide sequence encoding human NMDA receptor subunit pCMV-26-ScaI-22, which differs from Sequence ID No. 5 only in the deletion of nucleotides 1960–1974 of Sequence ID No. 5.

Sequence ID No. 49 is a nucleotide sequence encoding human NMDA receptor subunit pCMV-26-ScaI-21-NotI-24, which differs from Sequence ID No. 5 only in the deletion of nucleotides 2351–2401 of Sequence ID No. 5.

Sequence ID No. 51 is a nucleotide sequence encoding human NMDA receptor subunit NMDAR2C-Δ15-I24. Sequence ID No. 51 is the same as Sequence ID No. 47, except Sequence ID No. 51 further contains the 24 nucleotide insert set forth in Sequence ID No. 7, positioned between nucleotides 2350 and 2351 of Sequence ID No. 5.

Sequence ID No. 53 is a nucleotide sequence encoding human NMDA receptor subunit NMDAR2C-Δ15-Δ51. Sequence ID No. 53 is the same as Sequence ID No. 49, except Sequence ID No. 53 does not contain the 15 nucleotides set forth as nucleotides 1960–1974 of Sequence ID No. 5.

Sequence ID No. 6 is the amino acid sequence of the NMDA receptor subunit set forth in Sequence ID No. 5.

Sequence ID No. 42 is the amino acid sequence of a portion of an NMDA receptor subunit as encoded by the nucleotide sequence of Sequence ID No. 41.

The amino acid sequence of a portion of an NMDA receptor subunit as encoded by the nucleotide sequence of Sequence ID No. 43 is set forth in Sequence ID No. 43.

The amino acid sequence of a portion of an NMDA receptor subunit as encoded by the nucleotide sequence of Sequence ID No. 44 is set forth in Sequence ID No. 44.

Sequence ID No. 46 is the amino acid sequence of an NMDA receptor subunit encoded by the nucleotide sequence of Sequence ID No. 45.

Sequence ID No. 48 is the amino acid sequence of an NMDA receptor subunit encoded by the nucleotide sequence of Sequence ID No. 47.

Sequence ID No. 50 is the amino acid sequence of an NMDA receptor subunit encoded by the nucleotide sequence of Sequence ID No. 49.

Sequence ID No. 52 is the amino acid sequence of an NMDA receptor subunit encoded by the nucleotide sequence of Sequence ID No. 51.

Sequence ID No. 54 is the amino acid sequence of an NMDA receptor subunit encoded by the nucleotide sequence of Sequence ID No. 53.

Sequence ID No. 7 is a nucleotide sequence encoding the 24 nucleotide insert present in Sequence ID Nos. 44, 45 and 51.

Sequence ID No. 8 is the 7 amino acid sequence encoded by nucleotides 2–22 of the insert set forth in Sequence ID No. 7. Because the insert is introduced within a codon, the insert itself only encodes 7 amino acids. The terminal residues of the nucleotide insert participate in forming codons with adjacent sequence at the site of insertion.

Sequence ID No. 9 is a nucleotide sequence encoding the 11 nucleotide insert present in Sequence ID Nos. 43 and 44.

Sequence ID No. 10 is a nucleotide sequence encoding a human N-methyl-D-aspartate (NMDA) receptor subunit, NMDAR2A.

Sequence ID No. 11 is the amino acid sequence of an NMDA receptor subunit as encoded by the nucleotide sequence set forth in Sequence ID No. 10.

Sequence ID No. 12 is the nucleotide sequence of 71 nucleotides of 5' untranslated sequence of clone NMDA27, plus the initiation codon (nucleotides 72–74) of said clone.

Sequence ID No. 53 is a nucleotide sequence of a clone encoding a human N-methyl-D-aspartate (NMDA) receptor subunit, NMDAR2B.

Sequence ID No. 56 is the amino acid sequence of the NMDA receptor subunit set forth in Sequence ID No. 55.

Sequence ID No. 57 is a nucleotide sequence of a clone encoding a human N-methyl-D-aspartate (NMDA) receptor subunit, NMDAR2D.

Sequence ID No. 58 is the amino acid sequence of the NMDA receptor subunit set forth in Sequence ID No. 57.

Sequence ID Nos. 59–62 are four synthetic oligonucleotides used in the preparation of an NMDAR2C clone (pCMV-26-NotI-24-GCMOD) having reduced GC nucleotide content between nucleotides 2957 and 3166.

Sequence ID No. 63 is the nucleotide sequence of the 195 basepair insert of NMDAR2C clone pCMV-26-NotI-24-GCMOD (replacing nucleotides 2966–3160 of Sequence ID No. 5).

SEQUENCE LISTING (63 sequences)

SEQ ID NO: 1 - DNA (cDNA), 4298 bp; both-stranded, both
  CDS 262..3078
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggtgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 2 - protein, 938 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 3 - DNA (cDNA), 63 bp; both-stranded, both
  CDS 1..63
agtaaaaaaaggaactatgaaaacctcgaccaactgtcctatgacaacaagcgcggacccaag

SEQ ID NO: 4 - protein, 21 aa
SKKRNYENLDQLSYDNKRGPK

SEQ ID NO: 5 - DNA (cDNA), 4068 bp; both-stranded, both
  CDS 189..3899
cccttaataagatttgctacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 6 - protein, 1236 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 7 - DNA (cDNA), 24 bp; both-stranded, both
  CDS 2..22
ctctgaggctcagcctgtccccag

SEQ ID NO: 8 - protein, 7 aa
SEAQPVP

SEQ ID NO: 9 - DNA (cDNA), 11 bp; unknown-stranded, unknown
agaagggggtg

SEQ ID NO: 10 - DNA (cDNA), 4808 bp; both-stranded, both
  CDS 311..4705
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttgggtcttggattactccagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaaggaaatgcctagtatcgaatctgatgtttaaaaatcttccattaatgttttatctatagggaaatacacgtaatggccaatgttctggagggtaaatgttggatgtccaatagtgccctgctaagaggaaggag

SEQ ID NO: 11 - protein, 1464 aa
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQMLDFISSHTFVPILGIHGGASMIMADKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVWVLDYSSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGNPATGEQVYQQDWAQNNALQLQKNKLRISRQHSYDNIVDKPRELDLSRPSRSISLKDRERLLEGNFYGSLFSVPSSKLSGKKSSLFPQGLEDSKRSKSLLPDHTSDNPFLHSHRDDQRLVIGRCPSDPYKHSLPSQAVNDSYLRSSLRSTASYCSRDSRGHNDVYISEHVMPYAANKNNMYSTPRVLNSCSNRRVYKEMPSIESDV

SEQ ID NO: 12 - DNA (cDNA), 74 bp; both-stranded, both
cgagggaggcggccggcgcggactctcttcgcgggcgcagcgccccttccccctcggaccctccggtggacatg

SEQ ID NO: 13 - DNA (cDNA), 3155 bp; both-stranded, both
  CDS 262..3030
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgt

SEQ ID NO: 14 - protein, 922 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 15 - DNA (cDNA), 2540 bp; both-stranded, both
  CDS 1..2334
aacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagc

SEQ ID NO: 16 - protein, 777 aa
NDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 17 - DNA (cDNA), 595 bp; both-stranded, both
  CDS 1..576
gaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 18 - protein, 191 aa
EDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTLARDCLQPCPAPWARESATRPPPPSLRVRDRPATLYRTSTPRARARAFPVRSRALPLRPQGAGAHRPTPTSRCMQW

SEQ ID NO: 19 - DNA (cDNA), 3935 bp; both-stranded, both
  CDS 262..3030
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 20 - protein, 922 aa; identical to SEQ ID NO: 14

SEQ ID NO: 21 - DNA (cDNA), 3211 bp; both-stranded, both
  CDS 262..3192
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 22 - protein, 976 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTLARDCLQPCPAPWARESATRPPPPSLRVRDRPATLYRTSTPRARARAFPVRSRALPLRPQGAGAHRPTPTSRCMQW

SEQ ID NO: 23 - DNA (cDNA), 4361 bp; both-stranded, both
  CDS 262..3141
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggtgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 24 - protein, 959 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 25 - DNA (cDNA), 4157 bp; both-stranded, both
  CDS 262..2937
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggtgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 26 - protein, 891 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 27 - DNA (cDNA), 3794 bp; both-stranded, both
  CDS 262..2889
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 28 - protein, 875 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 29 - DNA (cDNA), 4094 bp; both-stranded, both
  CDS 262..2874
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggtgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 30 - protein, 870 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 31 - DNA (cDNA), 3731 bp; both-stranded, both
  CDS 262..2826
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 32 - protein, 854 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 33 - DNA (cDNA), 3007 bp; both-stranded, both
  CDS 262..2988
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 34 - protein, 908 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTLARDCLQPCPAPWARESATRPPPPSLRVRDRPATLYRTSTPRARARAFPVRSRALPLRPQGAGAHRPTPTSRCMQW

SEQ ID NO: 35 - DNA (cDNA), 3998 bp; both-stranded, both
  CDS 262..3093
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcaggcccctggggtctctgagcagtggggagcgggggctaactgcccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccaccaaacaccccgtctgccccttgacgccacacgccggggctggcgctgccctcccccacggccgtccctgacttcccagctggcagcgcctcccgccgcctcgggccgcctcctccagaatcgagagggctgagcccctcctctcctcgtccggcctgcagcacagaagggggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 36 - protein, 943 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 37 - DNA (cDNA), 3274 bp; both-stranded, both
  CDS 262..3255
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 38 - protein, 997 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTLARDCLQPCPAPWARESATRPPPPSLRVRDRPATLYRTSTPRARARAFPVRSRALPLRPQGAGAHRPTPTSRCMQW

SEQ ID NO: 39 - DNA (cDNA), 3070 bp; both-stranded, both
  CDS 262..3051
caagccgggcgttcggagctgtgcccggccccgcttcagcaccgcggacagcgccggccgcgtggggctgagcgccgagcccccgcgcacgcttcagccccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcgcagccgcgctctgcccctccgtccccagggtgcaggcgcgcaccgcccaacccccacctcccggtgtatgcagtggtgatgcctaaaggaatgtcacg

SEQ ID NO: 40 - protein, 929 aa
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTLARDCLQPCPAPWARESATRPPPPSLRVRDRPATLYRTSTPRARARAFPVRSRALPLRPQGAGAHRPTPTSRCMQW

SEQ ID NO: 41 - DNA (cDNA), 2326 bp; both-stranded, both
  CDS 3..2324
ccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccg

SEQ ID NO: 42 - protein, 774 aa
GHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSG

SEQ ID NO: 43 - DNA (cDNA), 3698 bp; single-stranded, linear
  Coding Sequence 3...3698
tggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaacccagaagggggtgtgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagactttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 44 - DNA (cDNA), 3243 bp; unknown-stranded, unknown
  Coding Sequence 1...3243
gtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaacccagaagggggtgtgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggctctgaggctcagcctgtccccaggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 45 - DNA (cDNA), 4092 bp; both-stranded, both
  CDS 189..3923
cccttaataagatttgcnacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggctctgaggctcagcctgtccccaggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 46 - protein, 1244 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGSEAQPVPRKLDAFIYDAAVLNYMAGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 47 - DNA (cDNA), 4053 bp; both-stranded, both
  CDS 189..3884
cccttaataagatttgcnacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagactttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 48 - protein, 1231 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKTFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 49 - DNA (cDNA), 4017 bp; both-stranded, both
  CDS 189..3848
cccttaataagatttgcnacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagaagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 50 - protein, 1219 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 51 - DNA (cDNA), 4077 bp; both-stranded, both
  CDS 189..3908
cccttaataagatttgcnacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagactttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggctctgaggctcagcctgtccccaggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 52 - protein, 1239 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKTFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGSEAQPVPRKLDAFIYDAAVLNYMAGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 53 - DNA (cDNA), 4002 bp; both-stranded, both
  CDS 189..3833
cccttaataagatttgcnacgtacactcgagccatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgaccctccggtggacatgggtggggccctggggccggccctgttgctcacctcgctcttcggtgcctgggcagggctgggtccggggcagggcgagcagggcatgacggtggccgtggtgtttagcagctcagggccgccccaggcccagttccgtgtccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggaactggacccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggcacctactgaatgtcacctgggagggccgagacttctccttcagccctggtgggtacctggtccagcccaccatggtggtgatcgccctcaaccggcaccgcctctgggagatggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttggagccatatagccctgcagtgtgggtgatgatgtttgtcatgtgcctcactgtggtggccatcaccgtcttcatgttcgagtacttcagccctgtcagctacaaccagaacctcaccagaggcaagactttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagatacacggccaacctggccgccttcatgatccaagagcaatacatcgacactgtgtcgggcctcagtgacaagaagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatgggcaaggacgagggctgcaagctggtcaccattgggtctggcaaggtctttgctaccactggctacggcatcgccatgcagaaggactcccactggaagcgggccatagacctggcgctcttgcagttcctgggggacggagagacacagaaactggagacagtgtggctctcagggatctgccagaatgagaagaacgaggtgatgagcagcaagctggacatcgacaacatgggaggcgtcttctacatgctgctggtggccatggggctggccctgctggtcttcgcctgggagcacctggtctactggaagctgcgccactcggtgcccaactcatcccagctggacttcctgctggctttcagcaggggcatctacagctgcttcagcggggtgcagagcctcgccagcccaccgcggcaggccagcccggacctcacggccagctcggcccaggccagcgtgctcaagattctgcaggcagcccgcgacatggtgaccacggcgggcgtaagcaactccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagcccccggagctggaggacctgccgctgctcggtccggagcagctggcccggcgggaggccctgctgaacgcggcctgggcccggggctcgcgcccgagtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccgcctggcagcacagacagcacgtctgcctgcacgcccacgcccacctgccattgtgctggggggctgtctgtcctcaccttccaccctgtgacagccacggctcctggctctccggcgcctgggggcctctggggcacagcggcaggactctggggctgggcacaggctacagagacagtgggggactggacgagatcagcagtgtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattggcccttctctggcttctaccatgaaatcctggccatggcaccccagtgacagatgatgtcttccatggtcatcagtgacctcagctagcctca

SEQ ID NO: 54 - protein, 1214 aa
MGGALGPALLLTSLFGAWAGLGPGQGEQGMTVAVVFSSSGPPQAQFRVRLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELDPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKTFTIGKSVWLLWALVFNNSVPIENPRGTTSKIMVLVWAFFAVIFLARYTANLAAFMIQEQYIDTVSGLSDKKFQRPQDQYPPFRFGTVPNGSTERNIRSNYRDMHTHMVKFNQRSVEDALTSLKMGKDEGCKLVTIGSGKVFATTGYGIAMQKDSHWKRAIDLALLQFLGDGETQKLETVWLSGICQNEKNEVMSSKLDIDNMGGVFYMLLVAMGLALLVFAWEHLVYWKLRHSVPNSSQLDFLLAFSRGIYSCFSGVQSLASPPRQASPDLTASSAQASVLKILQAARDMVTTAGVSNSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPEPPELEDLPLLGPEQLARREALLNAAWARGSRPSHASLPSSVAEAFARPSSLPAGCTGPACARPDGHSACRRLAQAQSMCLPIYREACQEGEQAGAPAWQHRQHVCLHAHAHLPLCWGAVCPHLPPCDSHGSWLSGAWGPLGHSGRTLGLGTGYRDSGGLDEISSVARGTQGFPGPCTWRRISSLESEV

SEQ ID NO: 55 - DNA (cDNA), 5538 bp; both-stranded, both
  CDS 210..4664
ttgaatttgcatctcttcaagacacaagattaaaacaaaatttacgctaaattggattttaaattatcttccgttcatttatccttcgtctttcttatgtggatatgcaagcgagaagaagggactggacattcccaacatgctcactcccttaatctgtccgtctagaggtttggcttctacaaaccaagggagtcgacgagttgaagatgaagcccagagcggagtgctgttctcccaagttctggttggtgttggccgtcctggccgtgtcaggcagcagagctcgttctcagaagagcccccccagcattggcattgctgtcatcctcgtgggcacttccgacgaggtggccatcaaggatgcccacgagaaagatgatttccaccatctctccgtggtaccccgggtggaactggtagccatgaatgagaccgacccaaagagcatcatcacccgcatctgtgatctcatgtctgaccggaagatccagggggtggtgtttgctgatgacacagaccaggaagccatcgcccagatcctcgatttcatttcagcacagactctcaccccgatcctgggcatccacgggggctcctctatgataatggcagataaggatgaatcctccatgttcttccagtttggcccatcaattgaacagcaagcttccgtaatgctcaacatcatggaagaatatgactggtacatcttttctatcgtcaccacctatttccctggctaccaggactttgtaaacaagatccgcagcaccattgagaatagctttgtgggctgggagctagaggaggtcctcctactggacatgtccctggacgatggagattctaagatccagaatcagctcaagaaacttcaaagccccatcattcttctttactgtaccaaggaagaagccacctacatctttgaagtggccaactcagtagggctgactggctatggctacacgtggatcgtgcccagtctggtggcaggggatacagacacagtgcctgcggagttccccactgggctcatctctgtatcatatgatgaatgggactatggcctcccccccagagtgagagatggaattgccataatcaccactgctgcttctgacatgctgtctgagcacagcttcatccctgagcccaaaagcagttgttacaacacccacgagaagagaatctaccagtccaatatgctaaataggtatctgatcaatgtcacttttgaggggaggaatttgtccttcagtgaagatggctaccagatgcacccgaaactggtgataattcttctgaacaaggagaggaagtgggaaagggtggggaagtggaaagacaagtccctgcagatgaagtactatgtgtggccccgaatgtgtccagagactgaagagcaggaggatgaccatctgagcattgtgaccctggaggaggcaccatttgtcattgtggaaagtgtggaccctctgagtggaacctgcatgaggaacacagtcccctgccaaaaacgcatagtcactgagaataaaacagacgaggagccgggttacatcaaaaaatgctgcaaggggttctgtattgacatccttaagaaaatttctaaatctgtgaagttcacctatgacctttacctggttaccaatggcaagcatgggaagaaaatcaatggaacctggaatggtatgattggagaggtggtcatgaagagggcctacatggcagtgggctcactcaccatcaatgaggaacgatcggaggtggtcgacttctctgtgcccttcatagagacaggcatcagtgtcatggtgtcacgcagcaatgggactgtctcaccttctgccttcttagagccattcagcgctgacgtatgggtgatgatgtttgtgatgctgctcatcgtctcagccgtggctgtctttgtctttgagtacttcagccctgtgggttataacaggtgcctcgctgatggcagagagcctggtggaccctctttcaccatcggcaaagctatttggttgctctggggtctggtgtttaacaactccgtacctgtgcagaacccaaaggggaccacctccaagatcatggtgtcagtgtgggccttctttgctgtcatcttcctggccagctacactgccaacttagctgccttcatgatccaagaggaatatgtggaccaggtttctggcctgagcgacaaaaagttccagagacctaatgacttctcaccccctttccgctttgggaccgtgcccaacggcagcacagagagaaatattcgcaataactatgcagaaatgcatgcctacatgggaaagttcaaccagaggggtgtagatgatgcattgctctccctgaaaacagggaaactggatgccttcatctatgatgcagcagtgctgaactatatggcaggcagagatgaaggctgcaagctggtgaccattggcagtgggaaggtctttgcttccactggctatggcattgccatccaaaaagattctgggtggaagcgccaggtggaccttgctatcctgcagctctttggagatggggagatggaagaactggaagctctctggctcactggcatttgtcacaatgagaagaatgaggtcatgagcagccagctggacattgacaacatggcaggggtcttctacatgttgggggcggccatggctctcagcctcatcaccttcatctgcgaacaccttttctattggcagttccgacattgctttatgggtgtctgttctggcaagcctggcatggtcttctccatcagcagaggtatctacagctgcatccatggggtggcgatcgaggagcgccagtctgtaatgaactcccccaccgcaaccatgaacaacacacactccaacatcctgcgcctgctgcgcacggccaagaacatggctaacctgtctggtgtgaatggctcaccgcagagcgccctggacttcatccgacgggagtcatccgtctatgacatctcagagcaccgccgcagcttcacgcattctgactgcaaatcctacaacaacccgccctgtgaggagaacctcttcagtgactacatcagtgaggtagagagaacgttcgggaacctgcagctgaaggacagcaacgtgtaccaagatcactaccaccatcaccaccggccccatagtattggcagtgccagctccatcgatgggctctacgactgtgacaacccacccttcaccacccagtccaggtccatcagcaagaagcccctggacatcggcctcccctcctccaagcacagccagctcagtgacctgtacggcaaattctccttcaagagcgaccgctacagtggccacgacgacttgatccgctccgatgtctctgacatctcaacccacaccgtcacctatgggaacatcgagggcaatgccgccaagaggcgtaagcagcaatataaggacagcctgaagaagcggcctgcctcggccaagtcccgcagggagtttgacgagatcgagctggcctaccgtcgccgaccgccccgctcccctgaccacaagcgctacttcagggacaaggaagggctacgggacttctacctggaccagttccgaacaaaggagaactcaccccactgggagcacgtagacctgaccgacatctacaaggagcggagtgatgactttaagcgcgactccatcagcggaggagggccctgtaccaacaggtctcacatcaagcacgggacgggcgacaaacacggcgtggtcagcggggtacctgcaccttgggagaagaacctgaccaacgtggagtgggaggaccggtccgggggcaacttctgccgcagctgtccctccaagctgcacaactactccacgacggtgacgggtcagaactcgggcaggcaggcgtgcatccggtgtgaggcttgcaagaaagcaggcaacctgtatgacatcagtgaggacaactccctgcaggaactggaccagccggctgccccagtggcggtgacgtcaaacgcctccaccactaagtaccctcagagcccgactaattccaaggcccagaagaagaaccggaacaaactgcgccggcagcactcctacgacaccttcgtggacctgcagaaggaagaagccgccctggccccgcgcagcgtaagcctgaaagacaagggccgattcatggatgggagcccctacgcccacatgtttgagatgtcagctggcgagagcacctttgccaacaacaagtcctcagtgcccactgccggacatcaccaccacaacaaccccggcggcgggtacatgctcagcaagtcgctctaccctgaccgggtcacgcaaaaccctttcatccccacttttggggacgaccagtgcttgctccatggcagcaaatcctacttcttcaggcagcccacggtggcgggggcgtcgaaagccaggccggacttccgggcccttgtcaccaacaagccggtggtctcggcccttcatggggccgtgccagcccgtttccagaaggacatctgtatagggaaccagtccaacccctgtgtgcctaacaacacaaaccccagggctttcaatggctccagcaatgggcatgtttatgagaaactttctagtattgagtctgatgtctgagtgagggaacagagaggttaaggtgggtacgggagggtaaggctgtgggtcgcgtgatgcgcatgtcacggagggtgacgggggtgaacttggttcccatttgctcctttcttgttttaatttatttatgggatcctggagttctggttcctactgggggcaaccctggtgaccagcaccatctctcctccttttcacagttctctccttcttccccccgctgtcagccattcctgttcccatgagatgatgccatgggccctctcagcaggggagggtagagcggagaaaggaagggctgcatgcgggcttcctcctggtgtggaagagctccttgatatcctctttgagtgaagctgggagaaccaaaaagaggctatgtgagcacaaaggtagcttttcccaaactgatcttttcatttaggtgaggaagcaaaagcatctatgtgagaccatttagcacactgcttgtgaaaggaaagaggctctggctaaattcatgctgcttagatgacatctgtctaggaatcatgtgccaagcagaggttgggaggccatttgtgtttatatataagcccaaaaatgcttgcttcaaccccatgagactcgatagtggtggtgaacagaacccaaggtcattggtggcagagtggattcttgaacaaactggaaagtacgttatgatagtgtcccccggtgccttggggacaagagcaggtggattgtgcgtgcatgtgtgttcatgcacacttgcacccatgtgtagtcaggtgcctcaagagaaggcaaccttgactctttcgttgaatttgcatctcttcaagacacaagattaaaacaaaatttacgctaaattggattttaaattatcttc

SEQ ID NO: 56 - protein, 1484 aa
MKPRAECCSPKFWLVLAVLAVSGSRARSQKSPPSIGIAVILVGTSDEVAIKDAHEKDDFHHLSVVPRVELVAMNETDPKSIITRICDLMSDRKIQGVVFADDTDQEAIAQILDFISAQTLTPILGIHGGSSMIMADKDESSMFFQFGPSIEQQASVMLNIMEEYDWYIFSIVTTYFPGYQDFVNKIRSTIENSFVGWELEEVLLLDMSLDDGDSKIQNQLKKLQSPIILLYCTKEEATYIFEVANSVGLTGYGYTWIVPSLVAGDTDTVPAEFPTGLISVSYDEWDYGLPPRVRDGIAIITTAASDMLSEHSFIPEPKSSCYNTHEKRIYQSNMLNRYLINVTFEGRNLSFSEDGYQMHPKLVIILLNKERKWERVGKWKDKSLQMKYYVWPRMCPETEEQEDDHLSIVTLEEAPFVIVESVDPLSGTCMRNTVPCQKRIVTENKTDEEPGYIKKCCKGFCIDILKKISKSVKFTYDLYLVTNGKHGKKINGTWNGMIGEVVMKRAYMAVGSLTINEERSEVVDFSVPFIETGISVMVSRSNGTVSPSAFLEPFSADVWVMMFVMLLIVSAVAVFVFEYFSPVGYNRCLADGREPGGPSFTIGKAIWLLWGLVFNNSVPVQNPKGTTSKIMVSVWAFFAVIFLASYTANLAAFMIQEEYVDQVSGLSDKKFQRPNDFSPPFRFGTVPNGSTERNIRNNYAEMHAYMGKFNQRGVDDALLSLKTGKLDAFIYDAAVLNYMAGRDEGCKLVTIGSGKVFASTGYGIAIQKDSGWKRQVDLAILQLFGDGEMEELEALWLTGICHNEKNEVMSSQLDIDNMAGVFYMLGAAMALSLITFICEHLFYWQFRHCFMGVCSGKPGMVFSISRGIYSCIHGVAIEERQSVMNSPTATMNNTHSNILRLLRTAKNMANLSGVNGSPQSALDFIRRESSVYDISEHRRSFTHSDCKSYNNPPCEENLFSDYISEVERTFGNLQLKDSNVYQDHYHHHHRPHSIGSASSIDGLYDCDNPPFTTQSRSISKKPLDIGLPSSKHSQLSDLYGKFSFKSDRYSGHDDLIRSDVSDISTHTVTYGNIEGNAAKRRKQQYKDSLKKRPASAKSRREFDEIELAYRRRPPRSPDHKRYFRDKEGLRDFYLDQFRTKENSPHWEHVDLTDIYKERSDDFKRDSISGGGPCTNRSHIKHGTGDKHGVVSGVPAPWEKNLTNVEWEDRSGGNFCRSCPSKLHNYSTTVTGQNSGRQACIRCEACKKAGNLYDISEDNSLQELDQPAAPVAVTSNASTTKYPQSPTNSKAQKKNRNKLRRQHSYDTFVDLQKEEAALAPRSVSLKDKGRFMDGSPYAHMFEMSAGESTFANNKSSVPTAGHHHHNNPGGGYMLSKSLYPDRVTQNPFIPTFGDDQCLLHGSKSYFFRQPTVAGASKARPDFRALVTNKPVVSALHGAVPARFQKDICIGNQSNPCVPNNTNPRAFNGSSNGHVYEKLSSIESDV

SEQ ID NO: 57 - DNA (cDNA), 4695 bp; both-stranded, both
  CDS 485..4495
cgagaacacagcgagtgtgtgagtccctcccgctccagctcctccaagccgcggccgccgccgccaccctcgcccgcagcctcccgcagcctccctcggccaccggtgtctggtgggggtgttgcctgggtaggtcggcccggcccccaggggtctctcgagcgtctgccatctgcccgagaaacatgtgtggccacgtcctcgcctagtccaggtggccgcaaccttgggggagagacagggcaggacaggaccaaggtaagaggtaaggaggagacggcgccagggacagacaggaggtcccggcttgccgttgtgcgcaccaccactgccgccgccccggggcctgcccccgacatcggctctctgagccctcctcggaatcttggggtcgctggacgccgggttccggtcctggcccccccgccatccccccaacagaacagggtcatgaaaagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctccccatcgtgtccgagcacggcggcgccgcgctcgtgctcacgcccaaggagaagggctccaccttcctccacctgggctcttcccccgagcaacagcttcaggtcatctttgaggtgctggaggagtatgactggacgtcctttgtagccgtgaccactcgtgcccctggccaccgggccttcctgtcctacattgaggtgctgactgacggcagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggggagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcgcggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatgatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccaggggcatgtacagctgctgcagcgctgaggccgccccaccgcccgccaagcccccgccgccgccacagcccctgcccagccccgcgtaccccgcgccggggccggctcccgggcccgcacctttcgtcccccgcgagcgcgcctcagtggcccgctggcgccggcccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccggcctcctatttcgccatcgtacgcgacaaggagccagccgagccccccgccggcgccttccccggcttcccgtccccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgcttcgccgcgccgcccccgtgcttttacctcgatgtcgaccagtcgccgtcggactcggaggactcggagagcctggccggcgcgtccctggccggcctggatccctggtggttcgccgacttcccttacccgtatgccgatcgcctcgggcsgcccgcggcacgctacggattggtcgacaaactagggggctggctcgccgggagctgggactacctgcctccscgcagcggtcgggccgcctggcactgtcggcactgcgccagcctggagctgcttccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgctgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcctacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagg

SEQ ID NO: 58 - protein, 1336 aa
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVSEHGGAALVLTPKEKGSTFLHLGSSPEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLAVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPGPAPGPAPFVPRERASVARWRRPKGAGPPGGAGLADGFHRYYGPIEPQGLGLGLGEARAAPRGAAGRPLSPPAAQPPQKPPASYFAIVRDKEPAEPPAGAFPGFPSPPAPPAAAATAVGPPLCRLAFEDESPPAPARWPRSDPESQPLLGPGAGGAGGTGGAGGGAPAAPPPCFAAPPPCFYLDVDQSPSDSEDSESLAGASLAGLDPWWFADFPYPYADRLGXPAARYGLVDKLGGWLAGSWDYLPXRSGRAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 59 - DNA (cDNA), 71 bp; both-stranded, both
gggtggcggccgcagagcacctccaccatctccttgtcctactccaagatctggccctagtccatgtttgc

SEQ ID NO: 60 - DNA (cDNA), 71 bp; both-stranded, both
tggtggtccccaacctgtaggacttggttctggaggaggatctggtgtaggcaaacatggactagggccag

SEQ ID NO: 61 - DNA (cDNA), 61 bp; both-stranded, both
gttggggaccaccagatggaggtagagctgcacttgtacgaagagctccacaaccacctgg

SEQ ID NO: 62 - DNA (cDNA), 62 bp; both-stranded, both
cgtgagacgtcagacaaaggaggcccaggtgtaggtggtctaccaggtggttgtggagctct

SEQ ID NO: 63 - DNA (cDNA), 195 bp; both-stranded, both
ccgcagagcacctccaccatctccttgtcctactccaagatctggccctagtccatgtttgcctacaccagatcctcctccagaaccaagtcctacaggttggggaccaccagatggaggtagagctgcacttgtacgaagagctccacaaccacctggtagaccacctacacctgggcctcctttgtctgacgt

That which is claimed is:

1. An isolated and substantially pure receptor encoded by a DNA sequence, comprising a sequence of nucleotides that encode an human N-methyl-D-aspartate receptor subtype, wherein the sequence of nucleotides is set forth in any one of SEQ. ID. Nos. 5, 45, 47, 49, 51, or 53.

2. A substantially pure human N-methyl-D-aspartate receptor comprising the sequence of amino acids as set forth in any one of SEQ ID Nos. 6, 46, 48, 52 or 54.

3. The receptor according to claim 2, where the receptor is an human N-methyl-D-aspartate receptor type 2C subunit (NMDAR2C).

* * * * *